(12) United States Patent
Grandi et al.

(10) Patent No.: US 7,361,353 B2
(45) Date of Patent: Apr. 22, 2008

(54) IMMUNISATION AGAINST CHLAMYDIA TRACHOMATIS

(75) Inventors: Guido Grandi, Milan (IT); Giulio Ratti, Siena (IT)

(73) Assignee: Novartis Vaccines and Diagnostics, Inc., Emeryville, CA (US)

( * ) Notice: Subject to any disclaimer, the term of this patent is extended or adjusted under 35 U.S.C. 154(b) by 0 days.

(21) Appl. No.: 11/450,517

(22) Filed: Jun. 12, 2006

(65) Prior Publication Data

US 2006/0216308 A1    Sep. 28, 2006

Related U.S. Application Data

(63) Continuation of application No. 10/498,327, filed as application No. PCT/IB02/05761 on Dec. 12, 2002, now abandoned.

(30) Foreign Application Priority Data

Dec. 12, 2001 (GB) ................... 0129732.4
Aug. 6, 2002 (GB) ................... 0218233.5
Aug. 14, 2002 (GB) ................... 0218924.9

(51) Int. Cl.
*A61K 39/118* (2006.01)

(52) U.S. Cl. ................... 424/190.1; 424/263.1

(58) Field of Classification Search ................... None
See application file for complete search history.

(56) References Cited

U.S. PATENT DOCUMENTS 7,041,490 B1 *  5/2006  Griffais et al. ........... 435/252.3

FOREIGN PATENT DOCUMENTS

| WO | WO 95/12411 | 5/1995 |
| WO | WO 99/27105 | 6/1999 |
| WO | WO 99/28475 | 6/1999 |
| WO | WO 00/27994 | 5/2000 |
| WO | WO 00/34483 | 6/2000 |
| WO | WO 01/40474 | 6/2001 |
| WO | WO 01/81379 | 11/2001 |
| WO | WO 02/08267 | 1/2002 |
| WO | WO 03/041560 | 5/2003 |

OTHER PUBLICATIONS

Greenspan et al. (Nature Biotechnology 7: 936-937, 1999).*
Bowie et al (Science, 1990, 247:1306-1310).*
SCORE sequence alignment, result 2.*
Silk, Excerpt from On the Shores of the Unknown, A Short History of the Universe, Cambridge University Press, pp. 1-10.*
Colman, Res. Immunol., 145:33-36, 1994.*
Stephens RS et al: Genome sequence of an obligate intracellular pathogen of humans: Chlamydia trachomatis see comments!) Science, American Association for the Advancement of Science., US, vol. 282, No. 5389, Oct. 23, 1998, pp. 754-759, XP002104802 issn: 0036-8075.
Database EMBL 'Online! Oct. 16, 2001, XP002258111 accession No. EBI Database accession No. 084879 100% identity over the whole length with SEQ DI No: 1.
Kalman et al., "Comparative Genomes of Chlamydia pneumoniae and C. trachomatis," Nature Genetics, 21(4), 1999, pp. 385-389.
Anonymous Third party observations filed under Article 115 EPC European Patent Applications 99939279.8; 99939280.6; 99951023.3; 99954126.1; 99958455.0; 99960752.6;99963037.9;00901235.2; 00908862.6; 00925004.4; 00962125.1; 00962134.3; 00984741.9; 01928775.4; 01931274.3; 01954278.6; and 01959114.8, dated Mar. 23, 2006.
Greenspan et al. Nature Biotechnology 7: 936-937, 1999.
Bowie et al., Science, 1990, 247:1306-1310.
Freshney, Culture of Animal Cells, A Manual of Basic Technique, Alan R. Liss, Inc., 1983, New York, p. 4.
Dermer, Bio/Technology, 1994, vol. 12, p. 320.
STIC search report, p. 4, Feb. 2006.
Clifton, D.R. et al: "A chlamydial type III translocated protein is tyrosine-phosphorylated at the site of entry and associated with recruitment of actin," PNAS, Jul. 6, 2004, vol. 101, No. 27, pp. 10166-10171.

* cited by examiner

*Primary Examiner*—Robert A. Zeman
*Assistant Examiner*—Brian J Gangle
(74) *Attorney, Agent, or Firm*—Banner & Witcoff, Ltd.

(57) ABSTRACT

The present invention provides antigenic proteins of *Chlamydia trachomatis*. The proteins of the present invention are useful for eliciting an immune response to *Chlamydia* in a patient. For example, an effective amount of protein of the present invention or fraction thereof may be administered to a patient for eliciting a *Chlamydia* specific immune response. In another example, a method of raising an antibody specific for *Chlamydia trchomatis* elementary bodies (EB) is provided in which a protein of the present invention is administered to a patient.

2 Claims, 59 Drawing Sheets

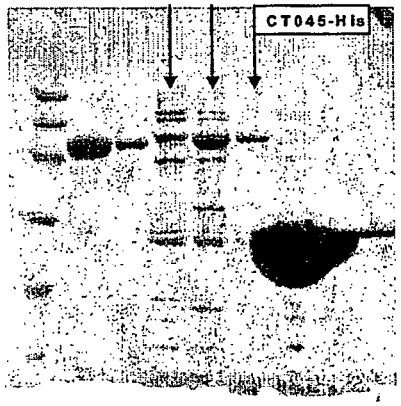
FIGURE 2A
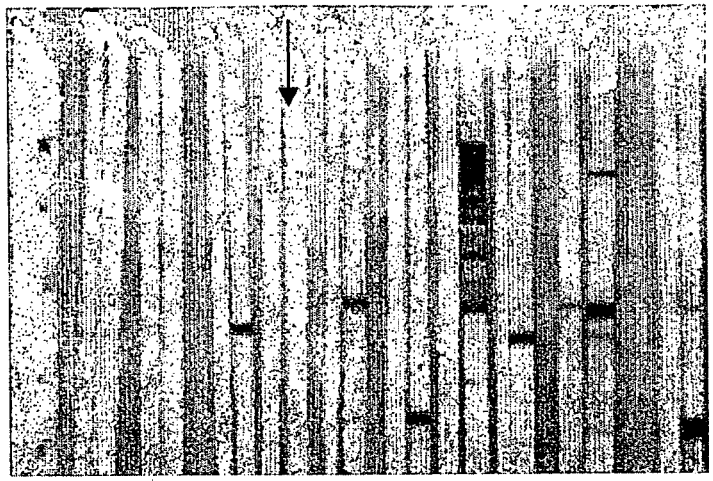
FIGURE 2B
FIGURE 2C
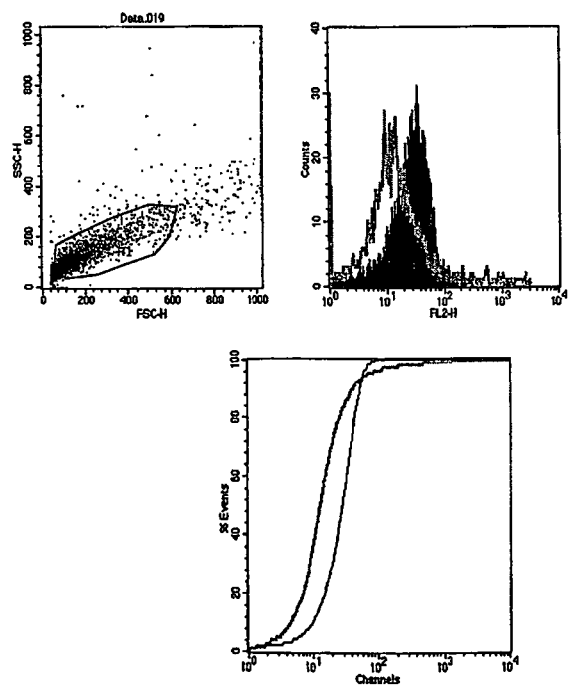

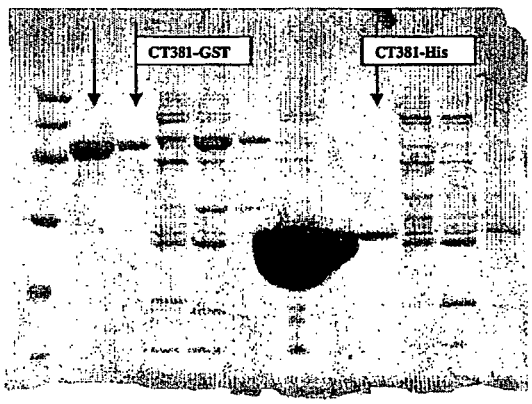
FIGURE 3A
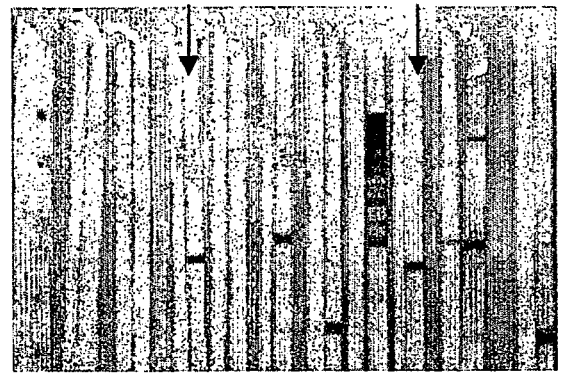
FIGURE 3B
FIGURE 3C
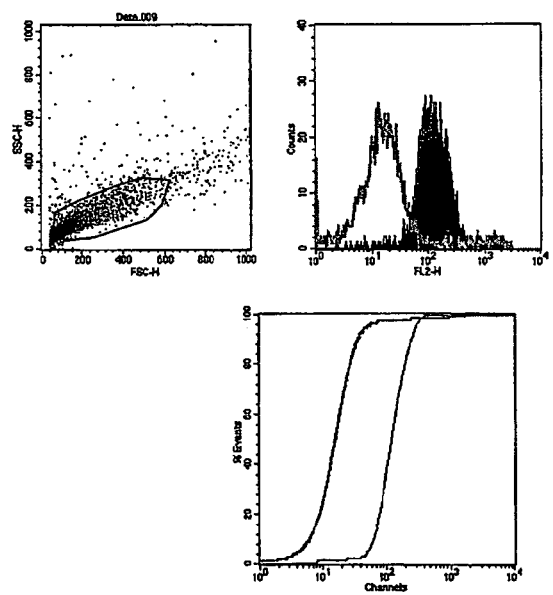

398-GST

381-GST

IMMUNISATION AGAINST *CHLAMYDIA TRACHOMATIS*

This application is a continuation application of and claims priority to U.S. Ser. No. 10/498,327, filed Dec. 16, 2004, which is a National Phase application of International Application No. PCT/IB02/05761, filed Dec. 12, 2002, all of which are incorporated herein in their entireties.

This application incorporates by reference the contents of each of two duplicate CD-ROMs. Each CD-ROM contains an identical 841 kB file labeled "Sequence Listing.txt" and containing the sequence listing for this application. The CD-ROMs were created on Jun. 8, 2006.

All documents cited herein are incorporated by reference in their entirety.

TECHNICAL FIELD

This invention is in the field of immunisation against chlamydial infection, in particular against infection by *Chlamydia trachomatis*.

BACKGROUND ART

*Chlamydiae* are obligate intracellular parasites of eukaryotic cells which are responsible for endemic sexually transmitted infections and various other disease syndromes. They occupy an exclusive eubacterial phylogenic branch, having no close relationship to any other known organisms—they are classified in their own order (*Chlamydiales*) which contains a single family (*Chlamydiaceae*) which in turn contains a single genus (*Chlamydia*, also referred to as *Chlamydophila*). A particular characteristic of the *Chlamydiae* is their unique life cycle, in which the bacterium alternates between two morphologically distinct forms: an extracellular infective form (elementary bodies, EB) and an intracellular non-infective form (reticulate bodies, RB). The life cycle is completed with the re-organization of RB into EB, which leave the disrupted host cell ready to infect further cells.

Four chlamydial species are currently known—*C.trachomatis, C.pneumoniae, C.pecorum* and *C.psittaci* {e.g. refs. 1, 2}— and genome sequences are available {refs. 3 to 9}.

The human serovariants ("serovars") of *C.trachomatis* are divided into two biovariants ("biovars"). Serovars A-K elicit epithelial infections primarily in the ocular tissue (A-C) or urogenital tract (D-K). Serovars L1, L2 and L3 are the agents of invasive lymphogranuloma venereum (LGV).

Although chlamydial infection itself causes disease, it is thought that, in some patients, the severity of symptoms is due, in fact, to an aberrant host immune response. Failure to clear the infection results in persistent immune stimulation and, rather than helping the host, this results in chronic infection with severe consequences, including sterility and blindness {10}. In addition, the protection conferred by natural chlamydial infection, is usually incomplete, transient, and strain-specific.

Due to the serious nature of the disease, there is a desire to provide suitable vaccines. These may be useful (a) for immunisation against chlamydial infection or against chlamydia-induced disease prophylactic vaccination) or (b) for the eradication of an established chronic chlamydial infection (therapeutic vaccination). Being an intracellular parasite, however, the bacterium can generally evade antibody-mediated immune responses.

Various antigenic proteins have been described for *C.trachomatis*, and the cell surface in particular has been the target of detailed research {eg. 1, 11}. These include, for instance, pgp3 {12, 13, 14}, MOMP {15}, Hsp60 (GroEL) {16} and Hsp70 (DnaK-like) {17}. Not all of these have proved to be effective vaccines, however, so it is an object of the invention to identify *C.trachomatis* antigens which elicit an immune response during natural infection, in order to provide antigens and immunogens suitable for use in vaccine development. It is a further object to identify antigens useful for diagnosis (e.g. immunodiagnosis) of *C.trachomatis*.

DISCLOSURE OF THE INVENTION

Reference 18 discloses various proteins from *C.pneumoniae* which were empirically verified as being immunoreactive, immunoaccessible and/or present in elementary bodies. These properties of the proteins were not derivable from the genomic sequence information. Reference 18 discloses that these proteins can be used in the treatment or prevention of infection due to *Chlamydia* bacteria, with *C.pneumoniae* being the main focus. The *C.pneumoniae* proteins can also be used for treating or preventing infection by other species of *Chlamydia*, due to inter-species cross-reactivity.

*C.pneumoniae* is closely related to *C.trachomatis*, as shown by whole genome comparisons {3,4,5}.

The present invention relates to *C.trachomatis* proteins (odd numbered SEQ IDs 1-261) which correspond to the *C.pneumoniae* proteins disclosed in reference 18. These proteins can be used in the treatment or prevention of infection due to *Chlamydia* bacteria, and in particular *C.trachomatis*. Particularly preferred proteins are those previously annotated as 'hypothetical protein' (see Table I herein) or those which were previously thought to have a cytoplasmic location.

*C.trachomatis* Proteins

The invention provides proteins comprising one or more of the odd-numbered amino acid sequences SEQ IDs 1-261.

It also provides proteins comprising sequences which share at least x % sequence identity with one or more of the odd-numbered amino acid sequences SEQ IDs 1-261. Depending on the particular sequence, x is preferably 50% or more (e.g. 60%, 70%, 80%, 90%, 95%, 99% or more). These include mutants and allelic variants. Typically, 50% identity or more between two proteins is considered to be an indication of functional equivalence. Identity between proteins is preferably determined by the Smith-Waterman homology search algorithm as implemented in the MPSRCH program (Oxford Molecular), using an affine gap search with parameters gap open penalty=12 and gap extension penalty=1.

The invention further provides proteins comprising fragments of the odd-numbered amino acid sequences SEQ IDs 1-261. The fragments should comprise at least n consecutive amino acids from the sequences and, depending on the particular sequence, n is 7 or more (e.g. 8, 10, 12, 14, 16, 18, 20, 30, 40, 50, 75, 100, 150, 200 or more). Preferably the fragments comprise one or more epitope(s) from the sequence. Other preferred fragments omit a signal peptide.

The proteins of the invention can be prepared by various means e.g. by chemical synthesis (at least in part), by digesting longer polypeptides using proteases, by translation from RNA, by purification from cell culture (e.g. from recombinant expression or from *C.trachomatis* culture) etc. Heterologous expression in *E.coli* is a preferred preparative route.

The proteins of the invention can take various forms e.g. native, fusions, glycosylated, non-glycosylated, lipidated etc.).

Proteins of the invention are preferably prepared in substantially pure form (ie. substantially free from other *C.trachomatis* or host cell proteins).

Proteins of the invention may be attached to a solid support. They may comprise a detectable label (e.g. a radioactive or fluorescent label, or a biotin label).

Proteins of the invention are preferably *Chlamydial* proteins.

*C.trachomatis* Nucleic Acids

The invention provides proteins comprising one or more of the even-numbered nucleotide sequences SEQ IDs 2-262.

The invention also provides nucleic acid comprising sequences which share at least x % sequence identity with the even-numbered nucleotide sequences SEQ IDs 2-262. Depending on the particular sequence, x is preferably 50% or more (e.g. 60%, 70%, 80%, 90%, 95%, 99% or more).

Furthermore, the invention provides nucleic acid which can hybridise to nucleic acid comprising the even-numbered nucleotide sequences SEQ IDs 2-262. Hybridisation reactions can be performed under conditions of different "stringency". Conditions that increase stringency of a hybridisation reaction of widely known and published in the art. Examples of relevant conditions include (in order of increasing stringency): incubation temperatures of 25° C., 37° C., 50° C., 55° C. and 68° C.; buffer concentrations of 10×SSC, 6×SSC, 1×SSC, 0.1×SSC and their equivalents using other buffer systems; formamide concentrations of 0%, 25%, 50%, and 75%; incubation times from 5 minutes to 24 hours; 1, 2, or more washing steps; wash incubation times of 1, 2, or 15 minutes; and wash solutions of 6×SSC, 1×SSC, 0.1×SSC, or de-ionized water. In some embodiments, the isolated nucleic acid of the invention selectively hybridises under low stringency conditions; in other embodiments it selectively hybridises under intermediate stringency conditions; in other embodiments, it selectively hybridises under high stringency conditions. An exemplary set of low stringency hybridisation conditions is 50° C. and 10×SSC. An exemplary set of intermediate stringency hybridisation conditions is 55° C. and 1×SSC. An exemplary set of high stringent hybridisation conditions is 68° C. and 0.1×SSC.

Nucleic acid comprising fragments of the even-numbered nucleotide sequences SEQ IDs 2-262 are also provided. These should comprise at least n consecutive nucleotides from the *C.trachomatis* sequences and, depending on the particular sequence, n is 7 or more (e.g. 10, 12, 14, 15, 18, 20, 25, 30, 35, 40, 50, 75, 100, 200, 300 or more).

According to a further aspect, the invention provides nucleic acid encoding the proteins and protein fragments of the invention.

The invention provides nucleic acid comprising sequences complementary to those described above (e.g. for antisense or probing purposes).

Nucleic acid of the invention can, of course, be prepared in many ways e.g. by chemical synthesis (at least in part), by digesting longer polynucleotides using restriction enzymes, from genomic or cDNA libraries, from the organism itself etc.

Nucleic acid of the invention can take various forms (e.g. single-stranded, double-stranded, linear, circular, vectors, primers, probes etc.).

Nucleic acids of the invention may be attached to a solid support (e.g. a bead, plate, filter, film, slide, resin, etc.). Nucleic acids of the invention may include a detectable label (e.g. a radioactive or fluorescent label, or a biotin label). This is particularly useful where the polynucleotide is to be used in nucleic acid detection techniques e.g. where the nucleic acid is a primer or as a probe for use in techniques such as PCR, LCR, TMA, NASBA, bDNA etc.

Nucleic acids of the invention are preferably *Chlamydial* nucleic acids.

The term "nucleic acid" includes DNA, RNA, DNA/RNA hybrids, and DNA or RNA analogs, such as those containing modified backbones or bases, and also peptide nucleic acids (PNA) etc.

Nucleic acids of the invention may be isolated and obtained in substantial purity, generally as other than an intact chromosome. Usually, the polynucleotides will be obtained substantially free of other naturally-occurring nucleic acid sequences, generally being at least about 50% (by weight) pure, usually at least about 90% pure.

Nucleic acids can be used, for example: to produce polypeptides; as probes for the detection of nucleic acid in biological samples; to generate additional copies of the polynucleotides; to generate ribozymes or antisense oligonucleotides; and as single-stranded DNA probes or as triple-strand forming oligonucleotides etc.

The invention provides vectors comprising nucleotide sequences of the invention (e.g. cloning or expression vectors) and host cells transformed therewith.

Compositions

According to a further aspect, the invention provides compositions comprising protein and/or nucleic acid according to the invention. These compositions are preferably immunogenic compositions, such as vaccines, and are suitable for immunisation and vaccination purposes. Vaccines of the invention may be prophylactic or therapeutic, and will typically comprise an antigen which can induce antibodies capable of inhibiting (a) chlamydial adhesion, (b) chlamydial entry, and/or (c) successful replication within the host cell. The vaccines preferably induce any cell-mediated T-cell responses which are necessary for chlamydial clearance from the host.

The invention also provides nucleic acid or protein according to the invention for use as medicaments (e.g. as vaccines).

The invention also provides the use of nucleic acid or protein according to the invention in the manufacture of a medicament (e.g. a vaccine or an immunogenic composition) for treating or preventing infection due to a *Chlamydia*. This will generally be *C.trachomatis* but, due to inter-species cross-reactivity, it may also be *C.pneumoniae, C.pecorum* or *C.psittaci*. For prevention, the medicament preferably elicits an immune response which is specific to the EB form of *Chlamydia*; for treatment, the medicament preferably elicits an immune response which is specific to the RB form of *Chlamydia.*

The invention also provides the use of nucleic acid or protein according to the invention in the manufacture of a medicament (e.g. a vaccine or an immunogenic composition) for neutralizing *Chlamydia trachomatis* elementary bodies.

The invention also provides a method of treating (e.g. immunising) a patient (e.g. a human), comprising administering to the patient a therapeutically effective amount of nucleic acid or protein according to the invention.

The invention also provides a method of raising an immune response in a patient, comprising administering to the patient an immunologically effective amount of nucleic acid or protein according to the invention. The immune response may involve raising antibodies in the patient and/or raising a cellular immune response (e.g. a CTL response). The immune response may be specific for an EB or a RB protein, or to a protein which is expressed in the host cytoplasm. An antibody response is preferably specific to an EB, whereas a cellular immune response is preferably specific to a cytoplasmic protein or, preferably, to an RB protein.

The invention also provides a method of raising antibodies which recognise a protein of the invention, comprising the step of administering to a patient a *Chlamydia* elementary body or reticulate body. The antibodies are preferably specific to an EB.

The invention also provides a method of neutralizing *C.trachomatis* infectivity, comprising the step of administering to a patient a protein, nucleic acid or antibody of the invention. The method preferably neutralizes EB infectivity.

The invention also provides a method for detecting a *Chlamydia* EB or RB in a biological sample, comprising the step of contacting an antibody of the invention with the sample. The sample could be a blood sample, another bodily fluid, or a tissue sample. The method may be used to diagnose chlamydial infection.

Immunogenic compositions of the invention may also include one or more of the following antigens:

- a protein antigen from *Helicobacter pylori* such as VacA, CagA, NAP, HopX, HopY {e.g. WO98/04702} and/or urease.
- a protein antigen from *N. meningitidis* serogroup B, such as those in WO99/24578, WO99/36544, WO99/57280, WO00/22430, Tettelin et al. (2000) *Science* 287:1809-1815, Pizza et al. (2000) *Science* 287:1816-1820 and WO96/29412, with protein '287' and derivatives being particularly preferred.
- an outer-membrane vesicle (OMV) preparation from *N.meningitidis* serogroup B, such as those disclosed in WO01/52885; Bjune et al. (1991) *Lancet* 338(8775): 1093-1096; Fukasawa et al. (1999) *Vaccine* 17:2951-2958; Rosenqvist et al. (1998) *Dev. Biol. Stand.* 92:323-333 etc.
- a saccharide antigen from *N.meningitidis* serogroup A, C, W135 and/or Y, such as the oligosaccharide disclosed in Costantino et al. (1992) *Vaccine* 10:691-698 from serogroup C {see also Costantino et al. (1999) *Vaccine* 17:1251-1263}.
- a saccharide antigen from *Streptococcus pneumoniae* {e.g. Watson (2000) *Pediatr Infect Dis J* 19:331-332; Rubin (2000) *Pediatr Clin North Am* 47:269-285, v; Jedrzejas (2001) *Microbiol Mol Biol Rev* 65:187-207}.
- an antigen from hepatitis A virus, such as inactivated virus {e.g. Bell (2000) *Pediatr Infect Dis J* 19:1187-1188; Iwarson (1995) *APMIS* 103:321-326}.
- an antigen from hepatitis B virus, such as the surface and/or core antigens {e.g. Gerlich et al. (1990) *Vaccine* 8 Suppl:S63-68 & 79-80}.
- an antigen from hepatitis C virus {e.g. Hsu et al. (1999) *Clin Liver Dis* 3:901-915}.
- an antigen from *Bordetella pertussis*, such as pertussis holotoxin (PT) and filamentous haemaglutitin (FHA) from *B.pertussis*, optionally also in combination with pertactin and/or agglutinogens 2 and 3 {e.g. Gustafsson et al. (1996) *N. Engl. J. Med.* 334:349-355; Rappuoli et al. (1991) *TIBTECH* 9:232-238}.
- a diphtheria antigen, such as a diphtheria toxoid {e.g. chapter 3 of *Vaccines* (1988) eds. Plotkin & Mortimer. ISBN 0-7216-1946-0} e.g. the $CRM_{197}$ mutant {e.g. Del Guidice et al. (1998) *Molecular Aspects of Medicine* 19:1-70}.
- a tetanus antigen, such as a tetanus toxoid {e.g. chapter 4 of Plotkin & Mortimer}.
- a saccharide antigen from *Haemophilus influenzae* B.
- an antigen from *N.gonorrhoeae* {e.g. WO99/24578, WO99/36544, WO99/57280}.
- an antigen from *Chlamydia pneumoniae* {e.g. PCT/IB01/01445; Kalman et al. (1999) *Nature Genetics* 21:385-389; Read et al. (2000) *Nucleic Acids Res* 28:1397-406; Shirai et al. (2000) *J. Infect. Dis.* 181(Suppl 3):S524-S527; WO99/27105; WO00/27994; WO00/37494}.
- an antigen from *Chlamydia trachomatis* {e.g. WO99/28475}.
- an antigen from *Porphyromonas gingivalis* {e.g. Ross et al. (2001) *Vaccine* 19:4135-4142}.
- polio antigen(s) {e.g. Sutter et al. (2000) *Pediatr Clin North Am* 47:287-308; Zimmerman & Spann (1999) *Am Fam Physician* 59:113-118, 125-126} such as IPV or OPV.
- rabies antigen(s) {e.g. Dreesen (1997) *Vaccine* 15 Suppl: S2-6} such as lyophilised inactivated virus {e.g. *MMWR Morb Mortal Wkly Rep* 1998 Jan. 16; 47(1):12, 19; RabAvert™}.
- measles, mumps and/or rubella antigens {e.g. chapters 9, 10 & 11 of Plotkin & Mortimer}.
- influenza antigen(s) {e.g. chapter 19 of Plotkin & Mortimer}, such as the haemagglutinin and/or neuraminidase surface proteins.
- an antigen from *Moraxella catarrhalis* {e.g. McMichael (2000) *Vaccine* 19 Suppl 1:S101-107}.
- an antigen from *Staphylococcus aureus* {e.g. Kuroda et al. (2001) *Lancet* 357(9264):1225-1240; see also pages 1218-1219}.
- an antigen from *Streptococcus agalactiae* {e.g. see WO02/34771}
- an antigen from *Streptococcus pyogenes* {e.g. see WO02/34771}

Where a saccharide or carbohydrate antigen is included, it is preferably conjugated to a carrier protein in order to enhance immunogenicity {e.g. Ramsay et al. (2001) *Lancet* 357(9251):195-196; Lindberg (1999) *Vaccine* 17 Suppl 2:S28-36; *Conjugate Vaccines* (eds. Cruse et al.) ISBN 3805549326, particularly vol. 10:48-114 etc.}. Preferred carrier proteins are bacterial toxins or toxoids, such as diphtheria or tetanus toxoids. The $CRM_{197}$ diphtheria toxoid is particularly preferred. Other suitable carrier proteins include the *N.meningitidis* outer membrane protein {e.g. EP-0372501}, synthetic peptides {e.g. EP-0378881, EP-0427347}, heat shock proteins {e.g. WO93/17712}, pertussis proteins {e.g. WO98/58668; EP-0471177}, protein D from *H.influenzae* {e.g. WO00/56360}, toxin A or B from *C.difficile* {e.g. WO00/61761}, etc. Any suitable conjugation reaction can be used, with any suitable linker where necessary.

Toxic protein antigens may be detoxified where necessary (e.g. detoxification of pertussis toxin by chemical and/or genetic means).

Where a diphtheria antigen is included in the composition it is preferred also to include tetanus antigen and pertussis antigens. Similarly, where a tetanus antigen is included it is preferred also to include diphtheria and pertussis antigens. Similarly, where a pertussis antigen is included it is preferred also to include diphtheria and tetanus antigens.

Antigens are preferably adsorbed to an aluminium salt.

Antigens in the composition will typically be present at a concentration of at least 1 µg/ml each. In general, the concentration of any given antigen will be sufficient to elicit an immune response against that antigen.

The invention also provides compositions comprising two or more proteins of the present invention.

Processes

The invention provides a process for producing proteins of the invention, comprising the step of culturing a host cell according to the invention under conditions which induce protein expression.

The invention provides a process for producing protein or nucleic acid of the invention, wherein the protein or nucleic acid is synthesised in part or in whole using chemical means.

The invention provides a process for detecting *C.trachomatis* in a sample, wherein the sample is contacted with an antibody which binds to a protein of the invention.

A summary of standard techniques and procedures which may be employed in order to perform the invention (e.g. to utilise the disclosed sequences for immunisation) follows. This summary is not a limitation on the invention but, rather, gives examples that may be used, but are not required.

General

The practice of the present invention will employ, unless otherwise indicated, conventional techniques of molecular biology, microbiology, recombinant DNA, and immunology, which are within the skill of the art. Such techniques are explained fully in the literature e.g. Sambrook *Molecular Cloning; A Laboratory Manual, Second Edition* (1989) and *Third Edition* (2001); *DNA Cloning, Volumes I and ii* (D. N Glover ed. 1985); *Oligonucleotide Synthesis* (M. J. Gait ed, 1984); *Nucleic Acid Hybridization* (B. D. Hames & S. J. Higgins eds. 1984); *Transcription and Translation* (B. D. Hames & S. J. Higgins eds. 1984); *Animal Cell Culture* (R. I. Freshney ed. 1986); *Immobilized Cells and Enzymes* (IRL Press, 1986); B. Perbal, *A Practical Guide to Molecular Cloning* (1984); the *Methods in Enzymology* series (Academic Press, Inc.), especially volumes 154 & 155; *Gene Transfer Vectors for Mammalian Cells* (J. H. Miller and M. P. Calos eds. 1987, Cold Spring Harbor Laboratory); Mayer and Walker, eds. (1987), *Immunochemical Methods in Cell and Molecular Biology* (Academic Press, London); Scopes, (1987) *Protein Purification: Principles and Practice*, Second Edition (Springer-Verlag, N.Y.), and *Handbook of Experimental Immunology Volumes I-IV* (D. M. Weir and C. C. Blackwell eds 1986).

Standard abbreviations for nucleotides and amino acids are used in this specification.

Definitions

A composition containing X is "substantially free of" Y when at least 85% by weight of the total X+Y in the composition is X. Preferably, X comprises at least about 90% by weight of the total of X+Y in the composition, more preferably at least about 95% or even 99% by weight.

The term "comprising" means "including" as well as "consisting" e.g. a composition "comprising" X may consist exclusively of X or may include something additional to X, such as X+Y.

The term "heterologous" refers to two biological components that are not found together in nature. The components may be host cells, genes, or regulatory regions, such as promoters. Although the heterologous components are not found together in nature, they can function together, as when a promoter heterologous to a gene is operably linked to a gene. Another example is where a Chlamydial sequence is heterologous to a mouse host cell. A further examples would be two epitopes from the same or different proteins which have been assembled in a single protein in an arrangement not found in nature.

An "origin of replication" is a polynucleotide sequence that initiates and regulates replication of polynucleotides, such as an expression vector. The origin of replication behaves as an autonomous unit of polynucleotide replication within a cell, capable of replication under its own control. An origin of replication may be needed for a vector to replicate in a particular host cell. With certain origins of replication, an expression vector can be reproduced at a high copy number in the presence of the appropriate proteins within the cell. Examples of origins are the autonomously replicating sequences, which are effective in yeast; and the viral T-antigen, effective in COS-7 cells.

A "mutant" sequence is defined as DNA, RNA or amino acid sequence differing from but having sequence identity with the native or disclosed sequence. Depending on the particular sequence, the degree of sequence identity between the native or disclosed sequence and the mutant sequence is preferably greater than 50% (e.g. 60%, 70%, 80%, 90%, 95%, 99% or more, calculated using the Smith-Waterman algorithm as described above). As used herein, an "allelic variant" of a nucleic acid molecule, or region, for which nucleic acid sequence is provided herein is a nucleic acid molecule, or region, that occurs essentially at the same locus in the genome of another or second isolate, and that, due to natural variation caused by, for example, mutation or recombination, has a similar but not identical nucleic acid sequence. A coding region allelic variant typically encodes a protein having similar activity to that of the protein encoded by the gene to which it is being compared. An allelic variant can also comprise an alteration in the 5' or 3' untranslated regions of the gene, such as in regulatory control regions (e.g. see U.S. Pat. No. 5,753,235).

Expression Systems

The Chlamydial nucleotide sequences can be expressed in a variety of different expression systems; for example those used with mammalian cells, baculoviruses, plants, bacteria, and yeast.

i. Mammalian Systems

Mammalian expression systems are known in the art. A mammalian promoter is any DNA sequence capable of binding mammalian RNA polymerase and initiating the downstream (3') transcription of a coding sequence (e.g. structural gene) into mRNA. A promoter will have a transcription initiating region, which is usually placed proximal to the 5' end of the coding sequence, and a TATA box, usually located 25-30 base pairs (bp) upstream of the transcription initiation site. The TATA box is thought to direct RNA polymerase II to begin RNA synthesis at the correct site. A mammalian promoter will also contain an upstream promoter element, usually located within 100 to 200 bp upstream of the TATA box. An upstream promoter element determines the rate at which transcription is initiated and can act in either orientation {Sambrook et al. (1989) "Expression of Cloned Genes in Mammalian Cells." In *Molecular Cloning: A Laboratory Manual, 2nd ed*}.

Mammalian viral genes are often highly expressed and have a broad host range; therefore sequences encoding mammalian viral genes provide particularly useful promoter sequences. Examples include the SV40 early promoter, mouse mammary tumor virus LTR promoter, adenovirus major late promoter (Ad MLP), and herpes simplex virus promoter. In addition, sequences derived from non-viral genes, such as the murine metallotheionein gene, also provide useful promoter sequences. Expression may be either constitutive or regulated (inducible), depending on the promoter can be induced with glucocorticoid in hormone-responsive cells.

The presence of an enhancer element (enhancer), combined with the promoter elements described above, will usually increase expression levels. An enhancer is a regulatory DNA sequence that can stimulate transcription up to 1000-fold when linked to homologous or heterologous promoters, with synthesis beginning at the normal RNA start site. Enhancers are also active when they are placed upstream or downstream from the transcription initiation site, in either normal or flipped orientation, or at a distance of more than 1000 nucleotides from the promoter {Maniatis et al. (1987) *Science* 236:1237; Alberts et al. (1989) *Molecular Biology of the Cell,* 2nd ed.}. Enhancer elements derived from viruses may be particularly useful, because they usually have a broader host range. Examples include the SV40 early gene enhancer {Dijkema et al (1985) *EMBO J.* 4:761} and the enhancer/promoters derived from the long terminal repeat (LTR) of the Rous Sarcoma Virus {Gorman et al. (1982) *PNAS USA* 79:6777} and from human cytomegalovirus {Boshart et al. (1985) *Cell* 41:521}. Additionally, some enhancers are regulatable and become active only in the presence of an inducer, such as a hormone or metal ion {Sassone-Corsi and Borelli (1986) *Trends Genet.* 2:215; Maniatis et al. (1987) *Science* 236:1237}.

A DNA molecule may be expressed intracellularly in mammalian cells. A promoter sequence may be directly linked with the DNA molecule, in which case the first amino acid at the N-terminus of the recombinant protein will always be a methionine, which is encoded by the ATG start codon. If desired, the N-terminus may be cleaved from the protein by in vitro incubation with cyanogen bromide.

Alternatively, foreign proteins can also be secreted from the cell into the growth media by creating chimeric DNA molecules that encode a fusion protein comprised of a leader sequence fragment that provides for secretion of the foreign protein in mammalian cells. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell. The adenovirus triparite leader is an example of a leader sequence that provides for secretion of a foreign protein in mammalian cells.

Usually, transcription termination and polyadenylation sequences recognized by mammalian cells are regulatory regions located 3' to the translation stop codon and thus, together with the promoter elements, flank the coding sequence. The 3' terminus of the mature mRNA is formed by site-specific post-transcriptional cleavage and polyadenylation {Birnstiel et al. (1985) *Cell* 41:349; Proudfoot and Whitelaw (1988) "Termination and 3' end processing of eukaryotic RNA. In *Transcription and splicing* (ed. B. D. Hames and D. M. Glover); Proudfoot (1989) *Trends Biochem. Sci.* 14:105}. These sequences direct the transcription of an mRNA which can be translated into the polypeptide encoded by the DNA. Examples of transcription terminater/polyadenylation signals include those derived from SV40 {Sambrook et al (1989) "Expression of cloned genes in cultured mammalian cells." In *Molecular Cloning: A Laboratory Manual*}.

Usually, the above described components, comprising a promoter, polyadenylation signal, and transcription termination sequence are put together into expression constructs. Enhancers, introns with functional splice donor and acceptor sites, and leader sequences may also be included in an expression construct, if desired. Expression constructs are often maintained in a replicon, such as an extrachromosomal element (e.g. plasmids) capable of stable maintenance in a host, such as mammalian cells or bacteria. Mammalian replication systems include those derived from animal viruses, which require trans-acting factors to replicate. For example, plasmids containing the replication systems of papovaviruses, such as SV40 {Gluzman (1981) *Cell* 23:175} or polyomavirus, replicate to extremely high copy number in the presence of the appropriate viral T antigen. Additional examples of mammalian replicons include those derived from bovine papillomavirus and Epstein-Barr virus. Additionally, the replicon may have two replicaton systems, thus allowing it to be maintained, for example, in mammalian cells for expression and in a prokaryotic host for cloning and amplification. Examples of such mammalian-bacteria shuttle vectors include pMT2 {Kaufman et al. (1989) *Mol. Cell. Biol.* 9:946} and pHEBO {Shimizu et al. (1986) *Mol. Cell. Biol.* 6:1074}.

The transformation procedure used depends upon the host to be transformed. Methods for introduction of heterologous polynucleotides into mammalian cells are known in the art and include dextran-mediated transfection, calcium phosphate precipitation, polybrene-mediated transfection, protoplast fusion, electroporation, encapsulation of polynucleotide(s) in liposomes, direct microinjection of the DNA into nuclei.

Mammalian cell lines available as hosts for expression are known in the art and include many immortalized cell lines available from the American Type Culture Collection (ATCC), including but not limited to, Chinese hamster ovary (CHO) cells, HeLa cells, baby hamster kidney (BHK) cells, monkey kidney cells (COS), human hepatocellular carcinoma cells (e.g. Hep G2), and a number of other cell lines.

ii. Baculovirus Systems

The polynucleotide encoding the protein can also be inserted into a suitable insect expression vector, and is operably linked to the control elements within that vector. Vector construction employs techniques which are known in the art. Generally, the components of the expression system include a transfer vector, usually a bacterial plasmid, which contains both a fragment of the baculovirus genome, and a convenient restriction site for insertion of the heterologous gene or genes to be expressed; a wild type baculovirus with a sequence homologous to the baculovirus-specific fragment in the transfer vector (this allows for the homologous recombination of the heterologous gene in to the baculovirus genome); and appropriate insect host cells and growth media.

After inserting the DNA sequence encoding the protein into the transfer vector, the vector and the wild type viral genome are transfected into an insect host cell where the vector and viral genome are allowed to recombine. The packaged recombinant virus is expressed and recombinant plaques are identified and purified. Materials and methods for baculovirus/insect cell expression systems are commercially available in kit form from, inter alia, Invitrogen, San Diego Calif. ("MaxBac" kit). These techniques are generally known to those skilled in the art and fully described in Summers and Smith, *Texas Agricultural Experiment Station Bulletin No.* 1555 (1987) (hereinafter "Summers and Smith").

Prior to inserting the DNA sequence encoding the protein into the baculovirus genome, the above described components, comprising a promoter, leader (if desired), coding sequence of interest, and transcription termination sequence, are usually assembled into an intermediate transplacement construct (transfer vector). This construct may contain a single gene and operably linked regulatory elements; multiple genes, each with its owned set of operably linked regulatory elements; or multiple genes, regulated by the same set of regulatory elements. Intermediate transplacement constructs are often maintained in a replicon, such as an extrachromosomal element (e.g. plasmids) capable of stable maintenance in a host, such as a bacterium. The replicon will have a replication system, thus allowing it to be maintained in a suitable host for cloning and amplification.

Currently, the most commonly used transfer vector for introducing foreign genes into AcNPV is pAc373. Many other vectors, known to those of skill in the art, have also been designed. These include, for example, pVL985 (which alters the polyhedrin start codon from ATG to ATT, and which introduces a BamHI cloning site 32 basepairs downstream from the ATT; see Luckow and Summers, *Virology* (1989) 17:31.

The plasmid usually also contains the polyhedrin polyadenylation signal (Miller et al. (1988) *Ann. Rev. Microbiol.,* 42:177) and a prokaryotic ampicillin-resistance (amp) gene and origin of replication for selection and propagation in *E.coli.*

Baculovirus transfer vectors usually contain a baculovirus promoter. A baculovirus promoter is any DNA sequence capable of binding a baculovirus RNA polymerase and initiating the downstream (5' to 3') transcription of a coding sequence (e.g. structural gene) into mRNA. A promoter will have a transcription initiation region which is usually placed proximal to the 5' end of the coding sequence. This transcription initiation region usually includes an RNA polymerase binding site and a transcription initiation site. A baculovirus transfer vector may also have a second domain called an enhancer, which, if present, is usually distal to the structural gene. Expression may be either regulated or constitutive.

Structural genes, abundantly transcribed at late times in a viral infection cycle, provide particularly useful promoter sequences. Examples include sequences derived from the gene encoding the viral polyhedron protein, Friesen et al., (1986) "The Regulation of Baculovirus Gene Expression," in: *The Molecular Biology of Baculoviruses* (ed. Walter Doerfler); EPO Publ. Nos. 127 839 and 155 476; and the gene encoding the p10 protein, Vlak et al., (1988), *J. Gen. Virol.* 69:765.

DNA encoding suitable signal sequences can be derived from genes for secreted insect or baculovirus proteins, such as the baculovirus polyhedrin gene (Carbonell et al. (1988) *Gene,* 73:409). Alternatively, since the signals for mammalian cell posttranslational modifications (such as signal peptide cleavage, proteolytic cleavage, and phosphorylation) appear to be recognized by insect cells, and the signals required for secretion and nuclear accumulation also appear to be conserved between the invertebrate cells and vertebrate cells, leaders of non-insect origin, such as those derived from genes encoding human α-interferon, Maeda et al., (1985), *Nature* 315:592; human gastrin-releasing peptide, Lebacq-Verheyden et al., (1988), *Molec. Cell. Biol.* 8:3129; human IL-2, Smith et al., (1985) *Proc. Nat'l Acad. Sci. USA,* 82:8404; mouse IL-3, (Miyajima et al., (1987) *Gene* 58:273; and human glucocerebrosidase, Martin et al. (1988) *DNA,* 7:99, can also be used to provide for secretion in insects.

A recombinant polypeptide or polyprotein may be expressed intracellularly or, if it is expressed with the proper regulatory sequences, it can be secreted. Good intracellular expression of nonfused foreign proteins usually requires heterologous genes that ideally have a short leader sequence containing suitable translation initiation signals preceding an ATG start signal. If desired, methionine at the N-terminus may be cleaved from the mature protein by in vitro incubation with cyanogen bromide.

Alternatively, recombinant polyproteins or proteins which are not naturally secreted can be secreted from the insect cell by creating chimeric DNA molecules that encode a fusion protein comprised of a leader sequence fragment that provides for secretion of the foreign protein in insects. The leader sequence fragment usually encodes a signal peptide comprised of hydrophobic amino acids which direct the translocation of the protein into the endoplasmic reticulum.

After insertion of the DNA sequence and/or the gene encoding the expression product precursor of the protein, an insect cell host is co-transformed with the heterologous DNA of the transfer vector and the genomic DNA of wild type baculovirus—usually by co-transfection. The promoter and transcription termination sequence of the construct will usually comprise a 2-5 kb section of the baculovirus genome. Methods for introducing heterologous DNA into the desired site in the baculovirus virus are known in the art. (See Summers and Smith supra; Ju et al. (1987); Smith et al., *Mol. Cell. Biol.* (1983) 3:2156; and Luckow and Summers (1989)). For example, the insertion can be into a gene such as the polyhedrin gene, by homologous double crossover recombination; insertion can also be into a restriction enzyme site engineered into the desired baculovirus gene. Miller et al., (1989), *Bioessays* 4:91. The DNA sequence, when cloned in place of the polyhedrin gene in the expression vector, is flanked both 5' and 3' by polyhedrin-specific sequences and is positioned downstream of the polyhedrin promoter.

The newly formed baculovirus expression vector is subsequently packaged into an infectious recombinant baculovirus. Homologous recombination occurs at low frequency (between ~1% and ~5%); thus, the majority of the virus produced after cotransfection is still wild-type virus. Therefore, a method is necessary to identify recombinant viruses. An advantage of the expression system is a visual screen allowing recombinant viruses to be distinguished. The polyhedrin protein, which is produced by the native virus, is produced at very high levels in the nuclei of infected cells at late times after viral infection. Accumulated polyhedrin protein forms occlusion bodies that also contain embedded particles. These occlusion bodies, up to 15 ì m in size are highly refractile, giving them a bright shiny appearance that is readily visualized under the light microscope. Cells infected with recombinant viruses lack occlusion bodies. To distinguish recombinant virus from wild-type virus, the transfection supernatant is plaqued onto a monolayer of insect cells by techniques known to those skilled in the art. Namely, the plaques are screened under the light microscope for the presence (indicative of wild-type virus) or absence (indicative of recombinant virus) of occlusion bodies. "Current Protocols in Microbiology" Vol. 2 (Ausubel et al. eds) at 16.8 (Supp. 10, 1990); Summers & Smith, supra; Miller et al. (1989).

Recombinant baculovirus expression vectors have been developed for infection into several insect cells. For example, recombinant baculoviruses have been developed for, inter alia: *Aedes aegpti, Autographa californica, Bombyx mori, Drosophila melanogaster, Spodoptera frugiperda,* and *Trichoplusia ni* (WO 89/046699; Carbonell et al., (1985) *J. Virol.* 56:153; Wright (1986) *Nature* 321:718; Smith et al., (1983) *Mol. Cell. Biol.* 3:2156; and see generally, Fraser, et al. (1989) *In Vitro Cell. Dev. Biol.* 25:225).

Cells and cell culture media are commercially available for both direct and fusion expression of heterologous polypeptides in a baculovirus/expression system; cell culture technology is generally known to those skilled in the art. See, e.g. Summers and Smith supra.

The modified insect cells may then be grown in an appropriate nutrient medium, which allows for stable maintenance of the plasmid(s) present in the modified insect host. Where the expression product gene is under inducible control, the host may be grown to high density, and expression induced. Alternatively, where expression is constitutive, the product will be continuously expressed into the medium and the nutrient medium must be continuously circulated, while removing the product of interest and augmenting depleted nutrients. The product may be purified by such techniques as chromatography, e.g. HPLC, affinity chromatography, ion exchange chromatography, etc.; electrophoresis; density gradient centrifugation; solvent extraction, or the like. As appropriate, the product may be further purified, as required, so as to remove substantially any insect proteins which are also secreted in the medium or result from lysis of insect cells, so as to provide a product which is at least substantially free of host debris, e.g. proteins, lipids and polysaccharides.

In order to obtain protein expression, recombinant host cells derived from the transformants are incubated under conditions which allow expression of the recombinant protein encoding sequence. These conditions will vary, dependent upon the host cell selected. However, the conditions are readily ascertainable to those of ordinary skill in the art, based upon what is known in the art.

iii. Plant Systems

There are many plant cell culture and whole plant genetic expression systems known in the art. Exemplary plant cellular genetic expression systems include those described in patents, such as: U.S. Pat. Nos. 5,693,506; 5,659,122; and 5,608,143. Additional examples of genetic expression in plant cell culture has been described by Zenk, *Phytochemistry* 30:3861-3863 (1991). Descriptions of plant protein signal peptides may be found in addition to the references described above in Vaulcombe et al., *Mol. Gen. Genet.* 209:3340 (1987); Chandler et al., *Plant Molecular Biology* 3:407418 (1984); Rogers, *J. Biol. Chem.* 260:3731-3738 (1985); Rothstein et al., *Gene* 55:353-356 (1987); Whittier et al., Nucleic Acids Research 15:2515-2535 (1987); Wirsel et al., *Molecular Microbiology* 3:3-14 (1989); Yu et al., *Gene* 122:247-253 (1992). A description of the regulation of plant gene expression by the phytohormone, gibberellic acid and secreted enzymes induced by gibberellic acid can be found in R. L. Jones and J. MacMillin, Gibberellins: in: *Advanced Plant Physiology*, Malcolm B. Wilkins, ed., 1984 Pitman Publishing Limited, London, pp. 21-52. References that describe other metabolically-regulated genes: Sheen, *Plant Cell*, 2:1027-1038(1990); Maas et al., *EMBO J.* 9:3447-3452 (1990); Benkel and Hickey, *Proc. Natl. Acad. Sci.* 84:1337-1339 (1987)

Typically, using techniques known in the art, a desired polynucleotide sequence is inserted into an expression cassette comprising genetic regulatory elements designed for operation in plants. The expression cassette is inserted into a desired expression vector with companion sequences upstream and downstream from the expression cassette suitable for expression in a plant host. The companion sequences will be of plasmid or viral origin and provide necessary characteristics to the vector to permit the vectors to move DNA from an original cloning host, such as bacteria, to the desired plant host. The basic bacterial/plant vector construct will preferably provide a broad host range prokaryote replication origin; a prokaryote selectable marker; and, for Agrobacterium transformations, T DNA sequences for Agrobacterium-mediated transfer to plant chromosomes. Where the heterologous gene is not readily amenable to detection, the construct will preferably also have a selectable marker gene suitable for determining if a plant cell has been transformed. A general review of suitable markers, for example for the members of the grass family, is found in Wilmink and Dons, 1993, *Plant Mol. Biol. Reptr,* 11(2):165-185.

Sequences suitable for permitting integration of the heterologous sequence into the plant genome are also recommended. These might include transposon sequences and the like for homologous recombination as well as Ti sequences which permit random insertion of a heterologous expression cassette into a plant genome. Suitable prokaryote selectable markers include resistance toward antibiotics such as ampicillin or tetracycline. Other DNA sequences encoding additional functions may also be present in the vector, as is known in the art.

The nucleic acid molecules of the subject invention may be included into an expression cassette for expression of the protein(s) of interest. Usually, there will be only one expression cassette, although two or more are feasible. The recombinant expression cassette will contain in addition to the heterologous protein encoding sequence the following elements, a promoter region, plant 5' untranslated sequences, initiation codon depending upon whether or not the structural gene comes equipped with one, and a transcription and translation termination sequence. Unique restriction enzyme sites at the 5' and 3' ends of the cassette allow for easy insertion into a pre-existing vector.

A heterologous coding sequence may be for any protein relating to the present invention. The sequence encoding the protein of interest will encode a signal peptide which allows processing and translocation of the protein, as appropriate, and will usually lack any sequence which might result in the binding of the desired protein of the invention to a membrane. Since, for the most part, the transcriptional initiation region will be for a gene which is expressed and translocated during germination, by employing the signal peptide which provides for translocation, one may also provide for translocation of the protein of interest. In this way, the protein(s) of interest will be translocated from the cells in which they are expressed and may be efficiently harvested. Typically secretion in seeds are across the aleurone or scutellar epithelium layer into the endosperm of the seed. While it is not required that the protein be secreted from the cells in which the protein is produced, this facilitates the isolation and purification of the recombinant protein.

Since the ultimate expression of the desired gene product will be in a eucaryotic cell it is desirable to determine whether any portion of the cloned gene contains sequences which will be processed out as introns by the host's splicosome machinery. If so, site-directed mutagenesis of the "intron" region may be conducted to prevent losing a portion of the genetic message as a false intron code, Reed and Maniatis, *Cell* 41:95-105, 1985.

The vector can be microinjected directly into plant cells by use of micropipettes to mechanically transfer the recombinant DNA. Crossway, *Mol. Gen. Genet,* 202:179-185, 1985. The genetic material may also be transferred into the plant cell by using polyethylene glycol, Krens, et al., *Nature*, 296, 72-74, 1982. Another method of introduction of nucleic acid segments is high velocity ballistic penetration by small particles with the nucleic acid either within the matrix of small beads or particles, or on the surface, Klein, et al., *Nature,* 327, 70-73, 1987 and Knudsen and Muller, 1991, *Planta,* 185:330-336 teaching particle bombardment of barley endosperm to create transgenic barley. Yet another method of introduction would be fusion of protoplasts with other entities, either minicells, cells, lysosomes or other fusible lipid-surfaced bodies, Fraley, et al., *Proc. Natl. Acad. Sci. USA,* 79, 1859-1863, 1982.

The vector may also be introduced into the plant cells by electroporation. (Fromm et al., *Proc. Natl. Acad. Sci. USA* 82:5824, 1985). In this technique, plant protoplasts are electroporated in the presence of plasmids containing the gene construct. Electrical impulses of high field strength reversibly permeabilize biomembranes allowing the introduction of the plasmids. Electroporated plant protoplasts reform the cell wall, divide, and form plant callus.

All plants from which protoplasts can be isolated and cultured to give whole regenerated plants can be transformed by the present invention so that whole plants are recovered which contain the transferred gene. It is known that practically all plants can be regenerated from cultured cells or tissues, including but not limited to all major species of sugarcane, sugar beet, cotton, fruit and other trees, legumes and vegetables. Some suitable plants include, for example, species from the genera *Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersion, Nicotiana, Solanum, Petunia, Digitalis, Majorana, Cichoriun, Helianthus, Lactuca, Bromus, Asparagus, Antirrhinum, Hererocallis, Nemesia, Pelargonium, Panicum, Pennisetum, Ranunculus, Senecio, Salpiglossis, Cucumis, Browaalia, Glycine, Loliun, Zea, Triticum, Sorghum,* and *Datura.*

Means for regeneration vary from species to species of plants, but generally a suspension of transformed protoplasts containing copies of the heterologous gene is first provided. Callus tissue is formed and shoots may be induced from callus and subsequently rooted. Alternatively, embryo formation can be induced from the protoplast suspension. These embryos germinate as natural embryos to form plants. The culture media will generally contain various amino acids and hormones, such as auxin and cytokinins. It is also advantageous to add glutamic acid and proline to the medium, especially for such species as corn and alfalfa. Shoots and roots normally develop simultaneously. Efficient regeneration will depend on the medium, on the genotype, and on the history of the culture. If these three variables are controlled, then regeneration is fully reproducible and repeatable.

In some plant cell culture systems, the desired protein of the invention may be excreted or alternatively the protein may be extracted from the whole plant. Where the desired protein of the invention is secreted into the medium, it may be collected. Alternatively, the embryos and embryoless-half seeds or other plant tissue may be mechanically disrupted to release any secreted protein between cells and tissues. The mixture may be suspended in a buffer solution to retrieve soluble proteins. Conventional protein isolation and purification methods will be then used to purify the recombinant protein. Parameters of time, temperature pH, oxygen, and volumes will be adjusted through routine methods to optimize expression and recovery of heterologous protein.

iv. Bacterial Systems

Bacterial expression techniques are known in the art. A bacterial promoter is any DNA sequence capable of binding bacterial RNA polymerase and initiating the downstream (3') transcription of a coding sequence (e.g. structural gene) into mRNA. A promoter will have a transcription initiation region which is usually placed proximal to the 5' end of the coding sequence. This transcription initiation region usually includes an RNA polymerase binding site and a transcription initiation site. A bacterial promoter may also have a second domain called an operator, that may overlap an adjacent RNA polymerase binding site at which RNA synthesis begins. The operator permits negative regulated (inducible) transcription, as a gene repressor protein may bind the operator and thereby inhibit transcription of a specific gene. Constitutive expression may occur in the absence of negative regulatory elements, such as the operator. In addition, positive regulation may be achieved by a gene activator protein binding sequence, which, if present is usually proximal (5') to the RNA polymerase binding sequence. An example of a gene activator protein is the catabolite activator protein (CAP), which helps initiate transcription of the lac operon in *Escherichia coli (E.coli)* {Raibaud et al. (1984) *Annu. Rev. Genet* 18:173}. Regulated expression may therefore be either positive or negative, thereby either enhancing or reducing transcription.

Sequences encoding metabolic pathway enzymes provide particularly useful promoter sequences. Examples include promoter sequences derived from sugar metabolizing enzymes, such as galactose, lactose (lac) {Chang et al. (1977) *Nature* 198:1056}, and maltose. Additional examples include promoter sequences derived from biosynthetic enzymes such as tryptophan (trp) {Goeddel et al. (1980) *Nuc. Acids Res.* 8:4057; Yelverton et al. (1981) *Nucl. Acids Res.* 9:731; U.S. Pat. No. 4,738,921; EP-A-0036776 and EP-A-0121775}. The g-laotamase (bla) promoter system {Weissmann (1981) "The cloning of interferon and other mistakes." In *Interferon* 3 (ed. I. Gresser)}, bacteriophage lambda PL {Shimatake et al. (1981) *Nature* 292:128} and T5 {U.S. Pat. No. 4,689,406} promoter systems also provide useful promoter sequences.

In addition, synthetic promoters which do not occur in nature also function as bacterial promoters. For example, transcription activation sequences of one bacterial or bacteriophage promoter may be joined with the operon sequences of another bacterial or bacteriophage promoter, creating a synthetic hybrid promoter {U.S. Pat. No. 4,551, 433}. For example, the tac promoter is a hybrid trp-lac promoter comprised of both trp promoter and lac operon sequences that is regulated by the lac repressor {Amann et al. (1983) *Gene* 25:167; de Boer et al. (1983) *Proc. Natl. Acad. Sci.* 80:21}. Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The bacteriophage T7 RNA polymerase/promoter system is an example of a coupled promoter system {Studier et al. (1986) *J. Mol. Biol.* 189:113; Tabor et al. (1985) *Proc Natl. Acad. Sci.* 82:1074}. In addition, a hybrid promoter can also be comprised of a bacteriophage promoter and an *E.coli* operator region (EPO-A-0 267 851).

In addition to a functioning promoter sequence, an efficient ribosome binding site is also useful for the expression of foreign genes in prokaryotes. In *E.coli,* the ribosome binding site is called the Shine-Dalgarno (SD) sequence and includes an initiation codon (ATG) and a sequence 3-9 nucleotides in length located 3-11 nucleotides upstream of the initiation codon {Shine et al. (1975) Nature 254:34}. The SD sequence is thought to promote binding of mRNA to the ribosome by the pairing of bases between the SD sequence and the 3' and of E.coli 16S rRNA {Steitz et al. (1979) "Genetic signals and nucleotide sequences in messenger RNA." In Biological Regulation and Development: Gene Expression (ed. R. F. Goldberger)}. To express eukaryotic genes and prokaryotic genes with weak ribosome-binding site {Sambrook et al. (1989) "Expression of cloned genes in Escherichia coli." In Molecular Cloning. A Laboratory Manual}.

A DNA molecule may be expressed intracellularly. A promoter sequence may be directly linked with the DNA molecule, in which case the first amino acid at the N-terminus will always be a methionine, which is encoded by the ATG start codon. If desired, methionine at the N-terminus may be cleaved from the protein by in vitro incubation with cyanogen bromide or by either in vivo on in vitro incubation with a bacterial methionine N-terminal peptidase (EPO-A-0 219 237).

Fusion proteins provide an alternative to direct expression. Usually, a DNA sequence encoding the N-terminal portion of an endogenous bacterial protein, or other stable protein, is fused to the 5' end of heterologous coding sequences. Upon expression, this construct will provide a fusion of the two amino acid sequences. For example, the bacteriophage lambda cell gene can be linked at the 5' terminus of a foreign gene and expressed in bacteria. The resulting fusion protein preferably retains a site for a processing enzyme (factor Xa) to cleave the bacteriophage protein from the foreign gene {Nagai et al. (1984) Nature 309:810}. Fusion proteins can also be made with sequences from the lacZ {Jia et al. (1987) Gene 60:197}, trpE {Allen et al. (1987) J. Biotechnol. 5:93; Makoff et al. (1989) J. Gen. Microbiol. 135:11}, and Chey {EP-A-0 324 647} genes. The DNA sequence at the junction of the two amino acid sequences may or may not encode a cleavable site. Another example is a ubiquitin fusion protein. Such a fusion protein is made with the ubiquitin region that preferably retains a site for a processing enzyme (e.g. ubiquitin specific processing-protease) to cleave the ubiquitin from the foreign protein. Through this method, native foreign protein can be isolated {Miller et al. (1989) Bio/Technology 7:698}.

Alternatively, foreign proteins can also be secreted from the cell by creating chimeric DNA molecules that encode a fusion protein comprised of a signal peptide sequence fragment that provides for secretion of the foreign protein in bacteria {U.S. Pat. No. 4,336,336}. The signal sequence fragment usually encodes a signal peptide comprised of hydrophobic amino acids which direct the secretion of the protein from the cell. The protein is either secreted into the growth media (gram-positive bacteria) or into the periplasmic space, located between the inner and outer membrane of the cell (gram-negative bacteria). Preferably there are processing sites, which can be cleaved either in vivo or in vitro encoded between the signal peptide fragment and the foreign gene.

DNA encoding suitable signal sequences can be derived from genes for secreted bacterial proteins, such as the E.coli outer membrane protein gene (ompA) {Masui et al. (1983), in: Experimental Manipulation of Gene Expression; Ghrayeb et al. (1984) EMBO J. 3:2437} and the E.coli alkaline phosphatase signal sequence (phoA) {Oka et al. (1985) Proc. Natl. Acad. Sci. 82:7212}. As an additional example, the signal sequence of the alpha-amylase gene from various Bacillus strains can be used to secrete heterologous proteins from B. subtilis {Palva et al (1982) Proc. Natl. Acad. Sci. USA 79:5582; EP-A-0 244 042}.

Usually, transcription termination sequences recognized by bacteria are regulatory regions located 3' to the translation stop codon, and thus together with the promoter flank the coding sequence. These sequences direct the transcription of an mRNA which can be translated into the polypeptide encoded by the DNA. Transcription termination sequences frequently include DNA sequences of about 50 nucleotides capable of forming stem loop structures that aid in terminating transcription. Examples include transcription termination sequences derived from genes with strong promoters, such as the trp gene in E.coli as well as other biosynthetic genes.

Usually, the above described components, comprising a promoter, signal sequence (if desired), coding sequence of interest, and transcription termination sequence, are put together into expression constructs. Expression constructs are often maintained in a replicon, such as an extrachromosomal element (e.g. plasmids) capable of stable maintenance in a host, such as bacteria. The replicon will have a replication system, thus allowing it to be maintained in a prokaryotic host either for expression or for cloning and amplification. In addition, a replicon may be either a high or low copy number plasmid. A high copy number plasmid will generally have a copy number ranging from about 5 to about 200, and usually about 10 to about 150. A host containing a high copy number plasmid will preferably contain at least about 10, and more preferably at least about 20 plasmids. Either a high or low copy number vector may be selected, depending upon the effect of the vector and the foreign protein on the host.

Alternatively, the expression constructs can be integrated into the bacterial genome with an integrating vector. Integrating vectors usually contain at least one sequence homologous to the bacterial chromosome that allows the vector to integrate. Integrations appear to result from recombinations between homologous DNA in the vector and the bacterial chromosome. For example, integrating vectors constructed with DNA from various Bacillus strains integrate into the Bacillus chromosome (EP-A-0 127 328). Integrating vectors may also be comprised of bacteriophage or transposon sequences.

Usually, extrachromosomal and integrating expression constructs may contain selectable markers to allow for the selection of bacterial strains that have been transformed. Selectable markers can be expressed in the bacterial host and may include genes which render bacteria resistant to drugs such as ampicillin, chloramphenicol, erythromycin, kanamycin (neomycin), and tetracycline {Davies et al. (1978) Annu Rev. Microbiol. 32:469}. Selectable markers may also include biosynthetic genes, such as those in the histidine, tryptophan, and leucine biosynthetic pathways.

Alternatively, some of the above described components can be put together in transformation vectors. Transformation vectors are usually comprised of a selectable market that is either maintained in a replicon or developed into an integrating vector, as described above.

Expression and transformation vectors, either extra-chromosomal replicons or integrating vectors, have been developed for transformation into many bacteria. For example, expression vectors have been developed for, inter alia, the following bacteria: Bacillus subtilis {Palva et al. (1982) Proc. Natl. Acad. Sci. USA 79:5582; EP-A-0 036 259 and EP-A-0 063 953; WO 84/04541}, Escherichia coli {Shimatake et al. (1981) *Nature* 292:128; Amann et al. (1985) *Gene* 40:183; Studier et al. (1986) *J. Mol. Biol.* 189:113; EP-A-0 036 776, EP-A-0 136 829 and EP-A-0 136 907}, *Streptococcus cremoris* {Powell et al. (1988) *Appl. Eviron. Microbiol.* 54:655}; *Streptococcus lividans* {Powell et al. (1988) *Appl. Environ. Microbiol.* 54:655}, *Streptomyces lividans* {U.S. Pat. No. 4,745,056}.

Methods of introducing exogenous DNA into bacterial hosts are well-known in the art, and usually include either the transformation of bacteria treated with $CaCl_2$ or other agents, such as divalent cations and DMSO. DNA can also be introduced into bacterial cells by electroporation. Transformation procedures usually vary with the bacterial species to be transformed. See e.g. {Masson et al. (1989) *FEMS Microbiol. Lett* 60:273; Palva et al. (1982) *Proc. Natl. Acad. Sci. USA* 79:5582; EP-A-0 036 259 and EP-A-0 063 953; WO 84/04541, *Bacillus*}, {Miller et al. (1988) *Proc. Natl. Acad. Sci.* 85:856; Wang et al. (1990) *J. Bacteriol.* 172:949, *Campylobacter*}, {Cohen et al. (1973) *Proc. Natl. Acad. Sci.* 69:2110; Dower et al. (1988) *Nucleic Acids Res.* 16:6127; Kushner (1978) "An improved method for transformation of *Escherichia coli* with ColE1-derived plasmids. In *Genetic Engineering. Proceedings of the International Symposium on Genetic Engineering* (eds. H. W. Boyer and S. Nicosia); Mandel et al. (1970) *J. Mol. Biol.* 53:159; Taketo (1988) *Biochim. Biophys. Acta* 949:318; *Escherichia*}, {Chassy et al. (1987) *FEMS Microbiol. Lett.* 44:173 *Lactobacillus*}; {Fiedler et al. (1988) *Anal. Biochem* 170:38, *Pseudomonas*}; {Augustin et al. (1990) *FEMS Microbiol. Lett.* 66:203, *Staphylococcus*}, {Barany et al. (1980) *J. Bacterial.* 144: 698; Harlander (1987) "Transformation of *Streptococcus lactis* by electroporation, in: *Streptococcal Genetics* (ed. J. Ferretti and R. Curtiss III); Perry et al. (1981) *Infect. Immun.* 32:1295; Powell et al. (1988) *Appl. Environ Microbiol.* 54:655; Somkuti et al. (1987) *Proc. 4th Evr. Cong. Biotechnology* 1:412, *Streptococcus*}.

v. Yeast Expression

Yeast expression systems are also known to one of ordinary skill in the art. A yeast promoter is any DNA sequence capable of binding yeast RNA polymerase and initiating the downstream (3') transcription of a coding sequence (e.g. structural gene) into mRNA. A promoter will have a transcription initiation region which is usually placed proximal to the 5' end of the coding sequence. This transcription initiation region usually includes an RNA polymerase binding site (the "TATA Box") and a transcription initiation site. A yeast promoter may also have a second domain called an upstream activator sequence (UAS), which, if present, is usually distal to the structural gene. The UAS permits regulated (inducible) expression. Constitutive expression occurs in the absence of a UAS. Regulated expression may be either positive or negative, thereby either enhancing or reducing transcription.

Yeast is a fermenting organism with an active metabolic pathway, therefore sequences encoding enzymes in the metabolic pathway provide particularly useful promoter sequences. Examples include alcohol dehydrogenase (ADH) (EP-A-0 284 044), enolase, glucolinase, glucose-6-phosphate isomerase, glyceraldehyde-3-phosphate-dehydrogenase (GAP or GAPDH), hexokinase, phosphofructokinase, 3-phosphoglycerate mutase, and pyruvate kinase (PyK) (EPO-A-0 329 203). The yeast PHO5 gene, encoding acid phosphatase, also provides useful promoter sequences {Myanohara et al. (1983) *Proc. Natl. Acad. Sci. USA* 80:1}.

In addition, synthetic promoters which do not occur in nature also function as yeast promoters. For example, UAS sequences of one yeast promoter may be joined with the transcription activation region of another yeast promoter, creating a synthetic hybrid promoter. Examples of such hybrid promoters include the ADH regulatory sequence linked to the GAP transcription activation region (U.S. Pat. Nos. 4,876,197 and 4,880,734). Other examples of hybrid promoters include promoters which consist of the regulatory sequences of either the ADH2, GAL4, GAL10, OR PHO5 genes, combined with the transcriptional activation region of a glycolytic enzyme gene such as GAP or PyK (EP-A-0 164 556). Furthermore, a yeast promoter can include naturally occurring promoters of non-yeast origin that have the ability to bind yeast RNA polymerase and initiate transcription. Examples of such promoters include, inter alia, {Cohen et al. (1980) *Proc. Natl. Acad. Sci. USA* 77:1078; Henikoff et al. (1981) *Nature* 283:835; Hollenberg et al. (1981) *Curr. Topics Microbiol. Immunol.* 96:119; Hollenberg et al. (1979) "The Expression of Bacterial Antibiotic Resistance Genes in the Yeast *Saccharomyces cerevisiae*," in: *Plasmids of Medical, Environmental and Commercial Importance* (eds. K. N. Timmis and A. Puhler); Mercerau-Puigalon et al. (1980) *Gene* 11:163; Panthier et al. (1980) *Curr. Genet.* 2:109}.

A DNA molecule may be expressed intracellularly in yeast. A promoter sequence may be directly linked with the DNA molecule, in which case the first amino acid at the N-terminus of the recombinant protein will always be a methionine, which is encoded by the ATG start codon. If desired, methionine at the N-terminus may be cleaved from the protein by in vitro incubation with cyanogen bromide.

Fusion proteins provide an alternative for yeast expression systems, as well as in mammalian, baculovirus, and bacterial expression systems. Usually, a DNA sequence encoding the N-terminal portion of an endogenous yeast protein, or other stable protein, is fused to the 5' end of heterologous coding sequences. Upon expression, this construct will provide a fusion of the two amino acid sequences. For example, the yeast or human superoxide dismutase (SOD) gene, can be linked at the 5' terminus of a foreign gene and expressed in yeast. The DNA sequence at the junction of the two amino acid sequences may or may not encode a cleavable site. See e.g. EP-A-0 196 056. Another example is a ubiquitin fusion protein. Such a fusion protein is made with the ubiquitin region that preferably retains a site for a processing enzyme (e.g. ubiquitin-specific processing protease) to cleave the ubiquitin from the foreign protein. Through this method, therefore, native foreign protein can be isolated (e.g. WO88/024066).

Alternatively, foreign proteins can also be secreted from the cell into the growth media by creating chimeric DNA molecules that encode a fusion protein comprised of a leader sequence fragment that provide for secretion in yeast of the foreign protein. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell.

DNA encoding suitable signal sequences can be derived from genes for secreted yeast proteins, such as the genes for invertase (EP-A-0012873; JPO 62,096,086) and A-factor (U.S. Pat. No. 4,588,684). Alternatively, leaders of non-yeast origin exit, such as an interferon leader, that also provide for secretion in yeast (EP-A-0060057).

A preferred class of secretion leaders are those that employ a fragment of the yeast alpha-factor gene, which contains both a "pre" signal sequence, and a "pro" region. The types of alpha-factor fragments that can be employed include the full-length pre-pro alpha factor leader (about 83 amino acid residues) as well as truncated alpha-factor leaders (usually about 25 to about 50 amino acid residues) (U.S. Pat. Nos. 4,546,083 and 4,870,008; EP-A-0 324 274). Additional leaders employing an alpha-factor leader fragment that provides for secretion include hybrid alpha-factor leaders made with a presequence of a first yeast, but a pro-region from a second yeast alphafactor. (e.g. see WO 89/02463.)

Usually, transcription termination sequences recognized by yeast are regulatory regions located 3' to the translation stop codon, and thus together with the promoter flank the coding sequence. These sequences direct the transcription of an mRNA which can be translated into the polypeptide encoded by the DNA. Examples of transcription terminator sequence and other yeast-recognized termination sequences, such as those coding for glycolytic enzymes.

Usually, the above described components, comprising a promoter, leader (if desired), coding sequence of interest, and transcription termination sequence, are put together into expression constructs. Expression constructs are often maintained in a replicon, such as an extrachromosomal element (e.g. plasmids) capable of stable maintenance in a host, such as yeast or bacteria. The replicon may have two replication systems, thus allowing it to be maintained, for example, in yeast for expression and in a prokaryotic host for cloning and amplification. Examples of such yeast-bacteria shuttle vectors include YEp24 {Botstein et al. (1979) *Gene* 8:17-24}, pCl/1 {Brake et al. (1984) *Proc. Natl. Acad Sci USA* 81:4642-4646}, and YRp17 {Stinchcomb et al. (1982) *J. Mol. Biol.* 158:157}. In addition, a replicon may be either a high or low copy number plasmid. A high copy number plasmid will generally have a copy number ranging from about 5 to about 200, and usually about 10 to about 150. A host containing a high copy number plasmid will preferably have at least about 10, and more preferably at least about 20. Enter a high or low copy number vector may be selected, depending upon the effect of the vector and the foreign protein on the host. See e.g. Brake et al., supra.

Alternatively, the expression constructs can be integrated into the yeast genome with an integrating vector. Integrating vectors usually contain at least one sequence homologous to a yeast chromosome that allows the vector to integrate, and preferably contain two homologous sequences flanking the expression construct. Integrations appear to result from recombinations between homologous DNA in the vector and the yeast chromosome {Orr-Weaver et al. (1983) *Methods in Enzymol.* 101:228-245}. An integrating vector may be directed to a specific locus in yeast by selecting the appropriate homologous sequence for inclusion in the vector. See Orr-Weaver et al., supra. One or more expression construct may integrate, possibly affecting levels of recombinant protein produced {Rine et al. (1983) *Proc. Natl. Acad. Sci. USA* 80:6750}. The chromosomal sequences included in the vector can occur either as a single segment in the vector, which results in the integration of the entire vector, or two segments homologous to adjacent segments in the chromosome and flanking the expression construct in the vector, which can result in the stable integration of only the expression construct.

Usually, extrachromosomal and integrating expression constructs may contain selectable markers to allow for the selection of yeast strains that have been transformed. Selectable markers may include biosynthetic genes that can be expressed in the yeast host, such as ADE2, HIS4, LEU2, TRP1, and ALG7, and the G418 resistance gene, which confer resistance in yeast cells to tunicamycin and G418, respectively. In addition, a suitable selectable marker may also provide yeast with the ability to grow in the presence of toxic compounds, such as metal. For example, the presence of CUP1 allows yeast to grow in the presence of copper ions {Butt et al. (1987) *Microbiol, Rev.* 51:351}.

Alternatively, some of the above described components can be put together into transformation vectors. Transformation vectors are usually comprised of a selectable marker that is either maintained in a replicon or developed into an integrating vector, as described above.

Expression and transformation vectors, either extrachromosomal replicons or integrating vectors, have been developed for transformation into many yeasts. For example, expression vectors have been developed for, inter alia, the following yeasts: *Candida albicans* {Kurtz, et al. (1986) *Mol. Cell. Biol.* 6:142}, *Candida maltosa* {Kunze, et al. (1985) *J. Basic Microbiol.* 25:141}. *Hansenula polymorpha* {Gleeson, et al. (1986) *J. Gen. Microbiol.* 132:3459; Roggenkamp et al. (1986) *Mol. Gen. Genet.* 202:302}, *Kluyveromyces fragilis* {Das, et al. (1984) *J. Bacteriol.* 158:1165}, *Kluyveromyces lactis* {De Louvencourt et al. (1983) *J. Bacteriol.* 154:737; Van den Berg et al. (1990) *Bio/Technology* 8:135}, *Pichia guillerimondii* {Kunze et al. (1985) *J. Basic Microbiol.* 25:141}, *Pichia pastoris* {Cregg, et al. (1985) *Mol. Cell. Biol.* 5:3376; U.S. Pat. Nos. 4,837, 148 and 4,929,555}, *Saccharomyces cerevisiae* {Hinnen et al. (1978) *Proc. Natl. Acad. Sci. USA* 75:1929; Ito et al. (1983) *J. Bacteriol* 153:163}, *Schizosaccharomyces pombe* {Beach and Nurse (1981) *Nature* 300:706}, and *Yarrowia lipolytica* {Davidow, et al. (1985) *Curr. Genet.* 10:380471 Gaillardin, et al. (1985) *Curr. Genet.* 10:49}.

Methods of introducing exogenous DNA into yeast hosts are well-known in the art, and usually include either the transformation of spheroplasts or of intact yeast cells treated with alkali cations. Transformation procedures usually vary with the yeast species to be transformed. See e.g. {Kurtz et al. (1986) *Mol. Cell. Biol.* 6:142; Kunze et al. (1985) *J. Basic Microbiol.* 25:141; *Candida*}; {Gleeson et al. (1986) *J. Gen. Microbiol.* 132:3459; Roggenkamp et al. (1986) *Mol. Gen. Genet* 202:302; *Hansenula*}; {Das et al. (1984) *J. Bacteriol.* 158:1165; De Louvencourt et al. (1983) *J. Bacteriol.* 154: 1165; Van den Berg et al. (1990) *Bio/Technology* 8:135; *Kluyveromyces*}; {Cregg et al. (1985) *Mol. Cell. Biol.* 5:3376; Kunze et al. (1985) *J. Basic Microbiol.* 25:141; U.S. Pat. Nos. 4,837,148 & 4,929,555; *Pichia*}; {Hinnen et al. (1978) *Proc. Natl. Acad. Sci. USA* 75;1929; Ito et al. (1983) *J. Bacteriol.* 153:163 *Saccharomyces*}; {Beach & Nurse (1981) *Nature* 300:706; *Schizosaccharomyces*}; {Davidow et al. (1985) *Curr. Genet.* 10:39; Gaillardin et al. (1985) *Curr. Genet.* 10:49; *Yarrowia*}.

Pharmaceutical Compositions

Pharmaceutical compositions can comprise polypeptides and/or nucleic acid of the invention. The pharmaceutical compositions will comprise a therapeutically effective amount of either polypeptides, antibodies, or polynucleotides of the claimed invention.

The term "therapeutically effective amount" as used herein refers to an amount of a therapeutic agent to treat, ameliorate, or prevent a desired disease or condition, or to exhibit a detectable therapeutic or preventative effect. The effect can be detected by, for example, chemical markers or antigen levels. Therapeutic effects also include reduction in physical symptoms, such as decreased body temperature. The precise effective amount for a subject will depend upon the subject's size and health, the nature and extent of the condition, and the therapeutics or combination of therapeutics selected for administration. Thus, it is not useful to specify an exact effective amount in advance. However, the effective amount for a given situation can be determined by routine experimentation and is within the judgement of the clinician.

For purposes of the present invention, an effective dose will be from about 0.01 mg/kg to 50 mg/kg or 0.05 mg/kg to about 10 mg/kg of the DNA constructs in the individual to which it is administered.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. The term refers to any pharmaceutical carrier that does not itself induce the production of antibodies harmful to the individual receiving the composition, and which may be administered without undue toxicity. Suitable carriers may be large, slowly metabolized macromolecules such as proteins, polysaccharides, polylactic acids, polyglycolic acids, polymeric amino acids, amino acid copolymers, and inactive virus particles. Such carriers are well known to those of ordinary skill in the art.

Pharmaceutically acceptable salts can be used therein, for example, mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in Remington's Pharmaceutical Sciences (Mack Pub. Co., N.J. 1991).

Pharmaceutically acceptable carriers in therapeutic compositions may contain liquids such as water, saline, glycerol and ethanol. Additionally, auxiliary substances, such as wetting or emulsifying agents, pH buffering substances, and the like, may be present in such vehicles. Typically, the therapeutic compositions are prepared as injectables, either as liquid solutions or suspensions; solid forms suitable for solution in, or suspension in, liquid vehicles prior to injection may also be prepared. Liposomes are included within the definition of a pharmaceutically acceptable carrier.

Delivery Methods

Once formulated, the compositions of the invention can be administered directly to the subject. The subjects to be treated can be animals; in particular, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal or transcutaneous applications (e.g. see WO98/20734), needles, and gene guns or hyposprays. Dosage treatment may be a single dose schedule or a multiple dose schedule.

Vaccines

Vaccines according to the invention may either be prophylactic (ie. to prevent infection) or therapeutic (ie. to treat disease after infection).

Such vaccines comprise immunising antigen(s), immunogen(s), polypeptide(s), protein(s) or nucleic acid, usually in combination with "pharmaceutically acceptable carriers," which include any carrier that does not itself induce the production of antibodies harmful to the individual receiving the composition. Suitable carriers are typically large, slowly metabolized macromolecules such as proteins, polysaccharides, polylactic acids, polyglycolic acids, polymeric amino acids, amino acid copolymers, lipid aggregates (such as oil droplets or liposomes), and inactive virus particles. Such carriers are well known to those of ordinary skill in the art. Additionally, these carriers may function as immunostimulating agents ("adjuvants"). Furthermore, the antigen or immunogen may be conjugated to a bacterial toxoid, such as a toxoid from diphtheria, tetanus, cholera, *H. pylon*, etc. pathogens.

Preferred adjuvants to enhance effectiveness of the composition include, but are not limited to: (1) aluminum salts (alum), such as aluminum hydroxide, aluminum phosphate, aluminum sulfate, etc; (2) oil-in-water emulsion formulations (with or without other specific immunostimulating agents such as muramyl peptides (see below) or bacterial cell wall components), such as for example (a) MF59™ (WO 90/14837; Chapter 10 in *Vaccine design: the subunit and adjuvant approach*, eds. Powell & Newman, Plenum Press 1995), containing 5% Squalene, 0.5% Tween 80, and 0.5% Span 85 (optionally containing various amounts of MTP-PE (see below), although not required) formulated into submicron particles using a microfluidizer such as Model 110Y microfluidizer (Microfluidics, Newton, Mass.), (b) SAF, containing 10% Squalane, 0.4% Tween 80, 5% pluronic-blocked polymer L121, and thr-MDP (see below) either microfluidized into a submicron emulsion or vortexed to generate a larger particle size emulsion, and (c) Ribi™ adjuvant system (RAS), (Ribi Immunochem, Hamilton, Mont.) containing 2% Squalene, 0.2% Tween 80, and one or more bacterial cell wall components from the group consisting of monophosphorylipid A (MPL), trehalose dimycolate (TDM), and cell wall skeleton (CWS), preferably MPL+ CWS (Detox™); (3) saponin adjuvants, such as Stimulon™ (Cambridge Bioscience, Worcester, Mass.) may be used or particles generated therefrom such as ISCOMs (immunostimulating complexes); (4) Complete Freund's Adjuvant (CFA) and Incomplete Freund's Adjuvant (IFA); (5) cytokines, such as interleukins (e.g. IL-1, IL-2, IL-4, IL-5, IL-6, IL-7, IL-12, etc.), interferons (e.g. gamma interferon), macrophage colony stimulating factor (M-CSF), tumor necrosis factor (TNF), etc; and (6) other substances that act as immunostimulating agents to enhance the effectiveness of the composition. Alum and MF59™ are preferred.

As mentioned above, muramyl peptides include, but are not limited to, N-acetyl-muramyl-L-threonyl-D-isoglutamine (thr-MDP), N-acetyl-normuramyl-L-alanyl-D-isoglutamine (nor-MDP), N-acetylmuramyl-L-alanyl-D-isoglutaminyl-L-alanine-2-(1'-2'-dipalmitoyl-sn-glycero-3-hydroxyphosphoryloxy)ethylamine (MTP-PE), etc.

The immunogenic compositions (e.g. the immunising antigen/immunogen/polypeptide/protein/nucleic acid, pharmaceutically acceptable carrier, and adjuvant) typically will contain diluents, such as water, saline, glycerol, ethanol, etc. Additionally, auxiliary substances, such as wetting or emulsifying agents, pH buffering substances, and the like, may be present in such vehicles.

Typically, the immunogenic compositions are prepared as injectables, either as liquid solutions or suspensions; solid forms suitable for solution in, or suspension in, liquid vehicles prior to injection may also be prepared. The preparation also may be emulsified or encapsulated in liposomes for enhanced adjuvant effect, as discussed above under pharmaceutically acceptable carriers.

Immunogenic compositions used as vaccines comprise an immunologically effective amount of the antigenic or immunogenic polypeptides, as well as any other of the above-mentioned components, as needed. By "immunologically effective amount", it is meant that the administration of that amount to an individual, either in a single dose or as part of a series, is effective for treatment or prevention. This amount varies depending upon the health and physical condition of the individual to be treated, the taxonomic group of individual to be treated (e.g. nonhuman primate, primate, etc.), the capacity of the individual's immune system to synthesize antibodies, the degree of protection desired, the formulation of the vaccine, the treating doctor's assessment of the medical situation, and other relevant factors. It is expected that the amount will fall in a relatively broad range that can be determined through routine trials.

The immunogenic compositions are conventionally administered parenterally, e.g. by injection, either subcutaneously, intramuscularly, or transdermally/transcutaneously (e.g. WO98/20734). Additional formulations suitable for other modes of administration include oral and pulmonary formulations, suppositories, and transdermal applications. Dosage treatment may be a single dose schedule or a multiple dose schedule. The vaccine may be administered in conjunction with other immunoregulatory agents.

As an alternative to protein-based vaccines, DNA vaccination may be employed {e.g. Robinson & Torres (1997) Seminars in Immunology 9:271-283; Donnelly et al. (1997) Annu Rev Immunol 15:617-648; see later herein}.

Gene Delivery Vehicles

Gene therapy vehicles for delivery of constructs including a coding sequence of a therapeutic of the invention, to be delivered to the mammal for expression in the mammal, can be administered either locally or systemically. These constructs can utilize viral or non-viral vector approaches in in vivo or ex vivo modality. Expression of such coding sequence can be induced using endogenous mammalian or heterologous promoters. Expression of the coding sequence in vivo can be either constitutive or regulated.

The invention includes gene delivery vehicles capable of expressing the contemplated nucleic acid sequences. The gene delivery vehicle is preferably a viral vector and, more preferably, a retroviral, adenoviral, adeno-associated viral (AAV), herpes viral, or alphavirus vector. The viral vector can also be an astrovirus, coronavirus, orthomyxovirus, papovavirus, paramyxovirus, parvovirus, picornavirus, poxvirus, or togavirus viral vector. See generally, Jolly (1994) Cancer Gene Therapy 1:51-64; Kimura (1994) Human Gene Therapy 5:845-852; Connelly (1995) Human Gene Therapy 6:185-193; and Kaplitt (1994) Nature Genetics 6:148-153.

Retroviral vectors are well known in the art and we contemplate that any retroviral gene therapy vector is employable in the invention, including B, C and D type retroviruses, xenotropic retroviruses (for example, NZB-X1, NZB-X2 and NZB9-1 (see O'Neill (1985) J. Virol. 53:160) polytropic retroviruses e.g. MCF and MCF-MLV (see Kelly (1983) J. Virol. 45:291), spumaviruses and lentiviruses. See RNA Tumor Viruses, Second Edition, Cold Spring Harbor Laboratory, 1985.

Portions of the retroviral gene therapy vector may be derived from different retroviruses. For example, retrovector LTRs may be derived from a Murine Sarcoma Virus, a tRNA binding site from a Rous Sarcoma Virus, a packaging signal from a Murine Leukemia Virus, and an origin of second strand synthesis from an Avian Leukosis Virus.

These recombinant retroviral vectors may be used to generate transduction competent retroviral vector particles by introducing them into appropriate packaging cell lines (see U.S. Pat. No. 5,591,624). Retrovirus vectors can be constructed for site-specific integration into host cell DNA by incorporation of a chimeric integrase enzyme into the retroviral particle (see WO96/37626). It is preferable that the recombinant viral vector is a replication defective recombinant virus.

Packaging cell lines suitable for use with the above-described retrovirus vectors are well known in the art, are readily prepared (see WO95/30763 and WO92/05266), and can be used to create producer cell lines (also termed vector cell lines or "VCLs") for the production of recombinant vector particles. Preferably, the packaging cell lines are made from human parent cells (e.g. HT1080 cells) or mink parent cell lines, which eliminates inactivation in human serum.

Preferred retroviruses for the construction of retroviral gene therapy vectors include Avian Leukosis Virus, Bovine Leukemia, Virus, Murine Leukemia Virus, Mink-Cell Focus-Inducing Virus, Murine Sarcoma Virus, Reticuloendotheliosis Virus and Rous Sarcoma Virus. Particularly preferred Murine Leukemia Viruses include 4070A and 1504A (Hartley and Rowe (1976) J Virol 19:19-25), Abelson (ATCC No. VR-999), Friend (ATCC No. VR-245), Graffi, Gross (ATCC Nol VR-590), Kirsten, Harvey Sarcoma Virus and Rauscher (ATCC No. VR-998) and Moloney Murine Leukemia Virus (ATCC No. VR-190). Such retroviruses may be obtained from depositories or collections such as the American Type Culture Collection ("ATCC") in Rockville, Md. or isolated from known sources using commonly available techniques.

Exemplary known retroviral gene therapy vectors employable in this invention include those described in patent applications GB2200651, EP0415731, EP0345242, EP0334301, WO89/02468; WO89/05349, WO89/09271, WO90/02806, WO90/07936, WO94/03622, WO93/25698, WO93/25234, WO93/11230, WO93/10218, WO91/02805, WO91/02825, WO95/07994, U.S. Pat. Nos. 5,219,740, 4,405,712, 4,861,719, 4,980,289, 4,777,127, 5,591,624. See also Vile (1993) Cancer Res 53:3860-3864; Vile (1993) Cancer Res 53:962-967; Ram (1993) Cancer Res 53 (1993) 83-88; Takamiya (1992) J Neurosci Res 33:493-503; Baba (1993) J Neurosurg 79:729-735; Mann (1983) Cell 33:153; Cane (1984) Proc Natl Acad Sci 81:6349; and Miller (1990) Human Gene Therapy 1.

Human adenoviral gene therapy vectors are also known in the art and employable in this invention. See, for example, Berkner (1988) Biotechniques 6:616 and Rosenfeld (1991) Science 252:431, and WO93/07283, WO93/06223, and WO93/07282. Exemplary known adenoviral gene therapy vectors employable in this invention include those described in the above referenced documents and in WO94/12649, WO93/03769, WO93/19191, WO94/28938, WO95/11984, WO95/00655, WO95/27071, WO95/29993, WO95/34671, WO96/05320, WO94/08026, WO94/11506, WO93/06223, WO94/24299, WO95/14102, WO95/24297, WO95/02697, WO94/28152, WO94/24299, WO95/09241, WO95/25807, WO95/05835, WO94/18922 and WO95/09654. Alternatively, administration of DNA linked to killed adenovirus as described in Curiel (1992) Hum. Gene Ther. 3:147-154 may be employed. The gene delivery vehicles of the invention also include adenovirus associated virus (AAV) vectors. Leading and preferred examples of such vectors for use in this invention are the AAV-2 based vectors disclosed in Srivastava, WO93/09239. Most preferred AAV vectors comprise the two AAV inverted terminal repeats in which the native D-sequences are modified by substitution of nucleotides, such that at least 5 native nucleotides and up to 18 native nucleotides, preferably at least 10 native nucleotides up to 18 native nucleotides, most preferably 10 native nucleotides are retained and the remaining nucleotides of the D-sequence are deleted or replaced with non-native nucleotides. The native D-sequences of the AAV inverted terminal repeats are sequences of 20 consecutive nucleotides in each AAV inverted terminal repeat (ie. there is one sequence at each end) which are not involved in HP formation. The non-native replacement nucleotide may be any nucleotide other than the nucleotide found in the native D-sequence in the same position. Other employable exemplary AAV vectors are pWP-19, pWN-1, both of which are disclosed in Nahreini (1993) *Gene* 124:257-262. Another example of such an AAV vector is psub201 (see Samulski (1987) *J. Virol.* 61:3096). Another exemplary AAV vector is the Double-D ITR vector. Construction of the Double-D ITR vector is disclosed in U.S. Pat. No. 5,478,745. Still other vectors are those disclosed in Carter U.S. Pat. No. 4,797,368 and Muzyczka U.S. Pat. No. 5,139,941, Chartejee U.S. Pat. No. 5,474,935, and Kotin WO94/288157. Yet a further example of an AAV vector employable in this invention is SSV9AFABTKneo, which contains the AFP enhancer and albumin promoter and directs expression predominantly in the liver. Its structure and construction are disclosed in Su (1996) *Human Gene Therapy* 7:463-470. Additional AAV gene therapy vectors are described in U.S. Pat. Nos. 5,354,678, 5,173,414, 5,139,941, and 5,252,479.

The gene therapy vectors of the invention also include herpes vectors. Leading and preferred examples are herpes simplex virus vectors containing a sequence encoding a thymidine kinase polypeptide such as those disclosed in U.S. Pat. No. 5,288,641 and EP0176170 (Roizman). Additional exemplary herpes simplex virus vectors include HFEM/ICP6-LacZ disclosed in WO95/04139 (Wistar), pHSVlac described in Geller (1988) *Science* 241:1667-1669 and in WO90/09441 & WO92/07945, HSV Us3::pgC-lacZ described in Fink (1992) *Human Gene Therapy* 3:11-19 and HSV 7134, 2 RH 105 and GAL4 described in EP 0453242 (Breakefield), and those deposited with ATCC as accession numbers ATCC VR-977 and ATCC VR-260.

Also contemplated are alpha virus gene therapy vectors that can be employed in this invention. Preferred alpha virus vectors are Sindbis viruses vectors. Togaviruses, Semliki Forest virus (ATCC VR-67; ATCC VR-1247), Middleberg virus (ATCC VR-370), Ross River virus (ATCC VR-373; ATCC VR-1246), Venezuelan equine encephalitis virus (ATCC VR923; ATCC VR-1250; ATCC VR-1249; ATCC VR-532), and those described in U.S. Pat. Nos. 5,091,309, 5,217,879, and WO92/10578. More particularly, those alpha virus vectors described in U.S. Ser. No. 08/405,627, filed Mar. 15, 1995, WO94/21792, WO92/10578, WO95/07994, U.S. Pat. Nos. 5,091,309 and 5,217,879 are employable. Such alpha viruses may be obtained from depositories or collections such as the ATCC in Rockville, Md. or isolated from known sources using commonly available techniques. Preferably, alphavirus vectors with reduced cytotoxicity are used (see U.S. Ser. No. 08/679,640).

DNA vector systems such as eukaryotic layered expression systems are also useful for expressing the nucleic acids of the invention. See WO95/07994 for a detailed description of eukaryotic layered expression systems. Preferably, the eukaryotic layered expression systems of the invention are derived from alphavirus vectors and most preferably from Sindbis viral vectors.

Other viral vectors suitable for use in the present invention include those derived from poliovirus, for example ATCC VR-58 and those described in Evans, Nature 339 (1989) 385 and Sabin (1973) *J. Biol. Standardization* 1:115; rhinovirus, for example ATCC VR-1110 and those described in Arnold (1990) *J Cell Biochem* L401; pox viruses such as canary pox virus or vaccinia virus, for example ATCC VR-111 and ATCC VR-2010 and those described in Fisher-Hoch (1989) *Proc Natl Acad Sci* 86:317; Flexner (1989) *Ann NY Acad Sci* 569:86, Flexner (1990) *Vaccine* 8:17; in U.S. Pat. Nos. 4,603,112 and 4,769,330 and WO89/01973; SV40 virus, for example ATCC VR-305 and those described in Mulligan (1979) *Nature* 277:108 and Madzak (1992) *J Gen Virol* 73:1533; influenza virus, for example ATCC VR-797 and recombinant influenza viruses made employing reverse genetics techniques as described in U.S. Pat. No. 5,166,057 and in Enami (1990) *Proc Natl Acad Sci* 87:3802-3805; Enami & Palese (1991) *J Virol* 65:2711-2713 and Luytjes (1989) *Cell* 59:110, (see also McMichael (1983) *NEJ Med* 309:13, and Yap (1978) *Nature* 273:238 and *Nature* (1979) 277:108); human immunodeficiency virus as described in EP-0386882 and in Buchschacher (1992) *J. Virol.* 66:2731; measles virus, for example ATCC VR-67 and VR-1247 and those described in EP-0440219; Aura virus, for example ATCC VR-368; Bebaru virus, for example ATCC VR-600 and ATCC VR-1240; Cabassou virus, for example ATCC VR-922; Chikungunya virus, for example ATCC VR-64 and ATCC VR-1241; Fort Morgan Virus, for example ATCC VR-924; Getah virus, for example ATCC VR-369 and ATCC VR-1243; Kyzylagach virus, for example ATCC VR-927; Mayaro virus, for example ATCC VR-66; Mucambo virus, for example ATCC VR-580 and ATCC VR-1244; Ndumu virus, for example ATCC VR-371; Pixuna virus, for example ATCC VR-372 and ATCC VR-1245; Tonate virus, for example ATCC VR-925; Triniti virus, for example ATCC VR-469; Una virus, for example ATCC VR-374; Whataroa virus, for example ATCC VR-926; Y-62-33 virus, for example ATCC VR-375; O'Nyong virus, Eastern encephalitis virus, for example ATCC VR-65 and ATCC VR-1242; Western encephalitis virus, for example ATCC VR-70, ATCC VR-1251, ATCC VR-622 and ATCC VR-1252; and coronavirus, for example ATCC VR-740 and those described in Hamre (1966) *Proc Soc Exp Biol Med* 121:190.

Delivery of the compositions of this invention into cells is not limited to the above mentioned viral vectors. Other delivery methods and media may be employed such as, for example, nucleic acid expression vectors, polycationic condensed DNA linked or unlinked to killed adenovirus alone, for example see U.S. Ser. No. 08/366,787, filed Dec. 30, 1994 and Curiel (1992) *Hum Gene Ther* 3:147-154 ligand linked DNA, for example see Wu (1989) *J Biol Chem* 264:16985-16987, eucaryotic cell delivery vehicles cells, for example see U.S. Ser. No. 08/240,030, filed May 9, 1994, and U.S. Ser. No. 08/404,796, deposition of photopolymerized hydrogel materials, hand-held gene transfer particle gun, as described in U.S. Pat. No. 5,149,655, ionizing radiation as described in U.S. Pat. No. 5,206,152 and in WO92/11033, nucleic charge neutralization or fusion with cell membranes. Additional approaches are described in Philip (1994) *Mol Cell Biol* 14:2411-2618 and in Woffendin (1994) *Proc Natl Acad Sci* 91:1581-1585.

Particle mediated gene transfer may be employed, for example see U.S. Ser. No. 60/023,867. Briefly, the sequence can be inserted into conventional vectors that contain conventional control sequences for high level expression, and then incubated with synthetic gene transfer molecules such as polymeric DNA-binding cations like polylysine, protamine, and albumin, linked to cell targeting ligands such as asialoorosomucoid, as described in Wu & Wu (1987) *J. Biol. Chem.* 262:4429-4432, insulin as described in Hucked (1990) *Biochem Pharmacol* 40:253-263, galactose as described in Plank (1992) *Bioconjugate Chem* 3:533-539, lactose or transferrin.

Naked DNA may also be employed. Exemplary naked DNA introduction methods are described in WO90/11092 and U.S. Pat. No. 5,580,859. Uptake efficiency may be improved using biodegradable latex beads. DNA coated latex beads are efficiently transported into cells after endocytosis initiation by the beads. The method may be improved further by treatment of the beads to increase hydrophobicity and thereby facilitate disruption of the endosome and release of the DNA into the cytoplasm.

Liposomes that can act as gene delivery vehicles are described in U.S. Pat. No. 5,422,120, WO95/13796, WO94/23697, WO91/14445 and EP-524,968. As described in U.S. Ser. No. 60/023,867, on non-viral delivery, the nucleic acid sequences encoding a polypeptide can be inserted into conventional vectors that contain conventional control sequences for high level expression, and then be incubated with synthetic gene transfer molecules such as polymeric DNA-binding cations like polylysine, protamine, and albumin, linked to cell targeting ligands such as asialoorosomucoid, insulin, galactose, lactose, or transferrin. Other delivery systems include the use of liposomes to encapsulate DNA comprising the gene under the control of a variety of tissue-specific or ubiquitously-active promoters. Further non-viral delivery suitable for use includes mechanical delivery systems such as the approach described in Woffendin et al (1994) *Proc. Natl. Acad. Sci. USA* 91(24):11581-11585. Moreover, the coding sequence and the product of expression of such can be delivered through deposition of photopolymerized hydrogel materials. Other conventional methods for gene delivery that can be used for delivery of the coding sequence include, for example, use of hand-held gene transfer particle gun, as described in U.S. Pat. No. 5,149,655; use of ionizing radiation for activating transferred gene, as described in U.S. Pat. No. 5,206,152 and WO92/11033

Exemplary liposome and polycationic gene delivery vehicles are those described in U.S. Pat. Nos. 5,422,120 and 4,762,915; in WO 95/13796; WO94/23697; and WO91/14445; in EP-0524968; and in Stryer, Biochemistry, pages 236-240 (1975) W.H. Freeman, San Francisco; Szoka (1980) *Biochem Biophys Acta* 600:1; Bayer (1979) *Biochem Biophys Acta* 550:464; Rivnay (1987) *Meth Enzymol* 149:119; Wang (1987) *Proc Natl Acad Sci* 84:7851; Plant (1989) *Anal Biochem* 176:420.

A polynucleotide composition can comprises therapeutically effective amount of a gene therapy vehicle, as the term is defined above. For purposes of the present invention, an effective dose will be from about 0.01 mg/kg to 50 mg/kg or 0.05 mg/kg to about 10 mg/kg of the DNA constructs in the individual to which it is administered.

Delivery Methods

Once formulated, the polynucleotide compositions of the invention can be administered (1) directly to the subject; (2) delivered ex vivo, to cells derived from the subject; or (3) in vitro for recombinant protein expression. The subjects to be treated can be mammals or birds. Also, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal or transcutaneous applications (e.g. see WO98/20734), needles, and gene guns or hyposprays. Dosage treatment may be a single dose schedule or a multiple dose schedule.

Methods for the ex vivo delivery and reimplantation of transformed cells into a subject are known in the art and described in e.g. WO93/14778. Examples of cells useful in ex vivo applications include, for example, stem cells, particularly hematopoetic, lymph cells, macrophages, dendritic cells, or tumor cells.

Generally, delivery of nucleic acids for both ex vivo and in vitro applications can be accomplished by the following procedures, for example, dextran-mediated transfection, calcium phosphate precipitation, polybrene mediated transfection, protoplast fusion, electroporation, encapsulation of the polynucleotide(s) in liposomes, and direct microinjection of the DNA into nuclei, all well known in the art.

Polynucleotide and Polypeptide Pharmaceutical Compositions

In addition to the pharmaceutically acceptable carriers and salts described above, the following additional agents can be used with polynucleotide and/or polypeptide compositions.

A. Polypeptides

One example are polypeptides which include, without limitation: asioloorosomucoid (ASOR); transferrin; asialoglycoproteins; antibodies; antibody fragments; ferritin; interleukins; interferons, granulocyte, macrophage colony stimulating factor (GM-CSF), granulocyte colony stimulating factor (G-CSF), macrophage colony stimulating factor (M-CSF), stem cell factor and erythropoietin. Viral antigens, such as envelope proteins, can also be used. Also, proteins from other invasive organisms, such as the 17 amino acid peptide from the circumsporozoite protein of *plasmodium falciparum* known as RII.

B. Hormones, Vitamins, etc.

Other groups that can be included are, for example: hormones, steroids, androgens, estrogens, thyroid hormone, or vitamins, folic acid.

C. Polyalkylenes, Polysaccharides, etc.

Also, polyalkylene glycol can be included with the desired polynucleotides/polypeptides. In a preferred embodiment, the polyalkylene glycol is polyethlylene glycol. In addition, mono-, di-, or polysaccharides can be included. In a preferred embodiment of this aspect, the polysaccharide is dextran or DEAE-dextran. Also, chitosan and poly(lactide-co-glycolide)

D. Lipids, and Liposomes

The desired polynucleotide/polypeptide can also be encapsulated in lipids or packaged in liposomes prior to delivery to the subject or to cells derived therefrom.

Lipid encapsulation is generally accomplished using liposomes which are able to stably bind or entrap and retain nucleic acid. The ratio of condensed polynucleotide to lipid preparation can vary but will generally be around 1:1 (mg DNA:micromoles lipid), or more of lipid. For a review of the use of liposomes as carriers for delivery of nucleic acids, see, Hug and Sleight (1991) *Biochim. Biophys. Acta.* 1097: 1-17; Straubinger (1983) *Meth. Enzymol.* 101:512-527.

Liposomal preparations for use in the present invention include cationic (positively charged), anionic (negatively charged) and neutral preparations. Cationic liposomes have been shown to mediate intracellular delivery of plasmid DNA (Felgner (1987) *Proc. Natl. Acad. Sci. USA* 84:7413-7416); mRNA (Malone (1989) *Proc. Natl. Acad. Sci. USA*

86:6077-6081); and purified transcription factors (Debs (1990) *J. Biol. Chem.* 265:10189-10192), in functional form.

Cationic liposomes are readily available. For example, N{1-2,3-dioleyloxy)propyl}-N,N,N-triethylammonium (DOTMA) liposomes are available under the trademark Lipofectin, from GIBCO BRL, Grand Island, N.Y. (See, also, Felgner supra). Other commercially available liposomes include transfectace (DDAB/DOPE) and DOTAP/DOPE (Boerhinger). Other cationic liposomes can be prepared from readily available materials using techniques well known in the art. See, e.g. Szoka (1978) *Proc. Natl. Acad. Sci. USA* 75:4194-4198; WO90/11092 for a description of the synthesis of DOTAP (1,2-bis(oleoyloxy)-3-(trimethylammonio)propane) liposomes.

Similarly, anionic and neutral liposomes are readily available, such as from Avanti Polar Lipids (Birmingham, Ala.), or can be easily prepared using readily available materials. Such materials include phosphatidyl choline, cholesterol, phosphatidyl ethanolamine, dioleoylphosphatidyl choline (DOPC), dioleoylphosphatidyl glycerol (DOPG), dioleoylphoshatidyl ethanolamine (DOPE), among others. These materials can also be mixed with the DOTMA and DOTAP starting materials in appropriate ratios. Methods for making liposomes using these materials are well known in the art.

The liposomes can comprise multilammelar vesicles (MLVs), small unilamellar vesicles (SUVs), or large unilamellar vesicles (LUJs). The various liposome-nucleic acid complexes are prepared using methods known in the art. See e.g. Straubinger (1983) *Meth. Immunol.* 101:512-527; Szoka (1978) *Proc. Natl. Acad. Sci. USA* 75:4194-4198; Papahadjopoulos (1975) *Biochim. Biophys. Acta* 394:483; Wilson (1979) *Cell* 17:77); Deamer & Bangham (1976) *Biochim. Biophys. Acta* 443:629; Ostro (1977) *Biochem. Biophys. Res. Commun.* 76:836; Fraley (1979) *Proc. Natl. Acad. Sci. USA* 76:3348); Enoch & Strittmatter (1979) *Proc. Natl. Acad. Sci. USA* 76:145; Fraley (1980) *J. Biol. Chem.* (1980) 255:10431; Szoka & Papahadjopoulos (1978) *Proc. Natl. Acad. Sci. USA* 75:145; and Schaefer-Ridder (1982) *Science* 215:166.

E. Lipoproteins

In addition, lipoproteins can be included with the polynucleotide/polypeptide to be delivered. Examples of lipoproteins to be utilized include: chylomicrons, HDL, IDL, LDL, and VLDL. Mutants, fragments, or fusions of these proteins can also be used. Also, modifications of naturally occurring lipoproteins can be used, such as acetylated LDL. These lipoproteins can target the delivery of polynucleotides to cells expressing lipoprotein receptors. Preferably, if lipoproteins are including with the polynucleotide to be delivered, no other targeting ligand is included in the composition.

Naturally occurring lipoproteins comprise a lipid and a protein portion. The protein portion are known as apoproteins. At the present, apoproteins A, B, C, D, and E have been isolated and identified. At least two of these contain several proteins, designated by Roman numerals, AI, AII, AIV; CI, CII, CIII.

A lipoprotein can comprise more than one apoprotein. For example, naturally occurring chylomicrons comprises of A, B, C, & E, over time these lipoproteins lose A and acquire C and E apoproteins. VLDL comprises A, B, C, & E apoproteins, LDL comprises apoprotein B; HDL comprises apoproteins A, C, & E.

The amino acid of these apoproteins are known and are described in, for example, Breslow (1985) Annu Rev. Biochem 54:699; Law (1986) Adv. Exp Med. Biol. 151:162; Chen (1986) J Biol Chem 261:12918; Kane (1980) Proc Natl Acad Sci USA 77:2465; and Utermann (1984) Hum Genet 65:232.

Lipoproteins contain a variety of lipids including, triglycerides, cholesterol (free and esters), and phospholipids. The composition of the lipids varies in naturally occurring lipoproteins. For example, chylomicrons comprise mainly triglycerides. A more detailed description of the lipid content of naturally occurring lipoproteins can be found, for example, in *Meth. Enzymol.* 128 (1986). The composition of the lipids are chosen to aid in conformation of the apoprotein for receptor binding activity. The composition of lipids can also be chosen to facilitate hydrophobic interaction and association with the polynucleotide binding molecule.

Naturally occurring lipoproteins can be isolated from serum by ultracentrifugation, for instance. Such methods are described in *Meth. Enzymol.* (*supra*); Pitas (1980) *J. Biochem.* 255:5454-5460 and Mahey (1979) *J Clin. Invest* 64:743-750. Lipoproteins can also be produced by in vitro or recombinant methods by expression of the apoprotein genes in a desired host cell. See, for example, Atkinson (1986) *Annu Rev Biophys Chem* 15:403 and Radding (1958) *Biochim Biophys Acta* 30: 443. Lipoproteins can also be purchased from commercial suppliers, such as Biomedical Technologies, Inc., Stoughton, Mass., USA. Further description of lipoproteins can be found in Zuckermann et al. PCT/US97/14465.

F. Polycationic Agents

Polycationic agents can be included, with or without lipoprotein, in a composition with the desired polynucleotide/polypeptide to be delivered.

Polycationic agents, typically, exhibit a net positive charge at physiological relevant pH and are capable of neutralizing the electrical charge of nucleic acids to facilitate delivery to a desired location. These agents have both in vitro, ex vivo, and in vivo applications. Polycationic agents can be used to deliver nucleic acids to a living subject either intramuscularly, subcutaneously, etc.

The following are examples of useful polypeptides as polycationic agents: polylysine, polyarginine, polyornithine, and protamine. Other examples include histones, protamines, human serum albumin, DNA binding proteins, non-histone chromosomal proteins, coat proteins from DNA viruses, such as (X174, transcriptional factors also contain domains that bind DNA and therefore may be useful as nucleic aid condensing agents. Briefly, transcriptional factors such as C/CEBP, c-jun, c-fos, AP-1, AP-2, AP-3, CPF, Prot-1, Sp-1, Oct-1, Oct-2, CREP, and TFIID contain basic domains that bind DNA sequences.

Organic polycationic agents include: spermine, spermidine, and purtrescine.

The dimensions and of the physical properties of a polycationic agent can be extrapolated from the list above, to construct other polypeptide polycationic agents or to produce synthetic polycationic agents.

Synthetic polycationic agents which are useful include, for example, DEAE-dextran, polybrene. Lipofectin™, and lipofectAMINE™ are monomers that form polycationic complexes when combined with polynucleotides/polypeptides.

Nucleic Acid Hybridisation

"Hybridization" refers to the association of two nucleic acid sequences to one another by hydrogen bonding. Typically, one sequence will be fixed to a solid support and the other will be free in solution. Then, the two sequences will be placed in contact with one another under conditions that favor hydrogen bonding. Factors that affect this bonding include: the type and volume of solvent; reaction temperature; time of hybridization; agitation; agents to block the non-specific attachment of the liquid phase sequence to the solid support (Denhardt's reagent or BLOTTO); concentration of the sequences; use of compounds to increase the rate of association of sequences (dextran sulfate or polyethylene glycol); and the stringency of the washing conditions following hybridization. See Sambrook et al {supra} vol. 2, chapt. 9, pp. 9.47 to 9.57.

"Stringency" refers to conditions in a hybridization reaction that favor association of very similar sequences over sequences that differ. For example, the combination of temperature and salt concentration should be chosen that is approximately 120 to 200° C. below the calculated Tm of the hybrid under study. The temperature and salt conditions can often be determined empirically in preliminary experiments in which samples of genomic DNA immobilized on filters are hybridized to the sequence of interest and then washed under conditions of different stringencies. See Sambrook et al. at page 9.50.

Variables to consider when performing, for example, a Southern blot are (1) the complexity of the DNA being blotted and (2) the homology between the probe and the sequences being detected. The total amount of the fragment(s) to be studied can vary a magnitude of 10, from 0.1 to 1 µg for a plasmid or phage digest to $10^{-9}$ to $10^{-8}$ g for a single copy gene in a highly complex eukaryotic genome. For lower complexity polynucleotides, substantially shorter blotting, hybridization, and exposure times, a smaller amount of starting polynucleotides, and lower specific activity of probes can be used. For example, a single-copy yeast gene can be detected with an exposure time of only 1 hour starting with 1 µg of yeast DNA, blotting for two hours, and hybridizing for 4-8 hours with a probe of $10^8$ cpm/µg. For a single-copy mammalian gene a conservative approach would start with 10 µg of DNA, blot overnight, and hybridize overnight in the presence of 10% dextran sulfate using a probe of greater than $10^8$ cpm/µg, resulting in an exposure time of ~24 hours.

Several factors can affect the melting temperature (Tm) of a DNA-DNA hybrid between the probe and the fragment of interest, and consequently, the appropriate conditions for hybridization and washing. In many cases the probe is not 100% homologous to the fragment. Other commonly encountered variables include the length and total G+C content of the hybridizing sequences and the ionic strength and formamide content of the hybridization buffer. The effects of all of these factors can be approximated by a single equation:

$$Tm=81+16.6(\log_{10}Ci)+0.4\{\%(G+C)\}-0.6(\% \text{ formamide})-600/n-1.5(\% \text{ mismatch}).$$

where Ci is the salt concentration (monovalent ions) and n is the length of the hybrid in base pairs (slightly modified from Meinkoth & Wahl (1984) Anal. Biochem. 138: 267-284).

In designing a hybridization experiment, some factors affecting nucleic acid hybridization can be conveniently altered. The temperature of the hybridization and washes and the salt concentration during the washes are the simplest to adjust. As the temperature of the hybridization increases (ie. stringency), it becomes less likely for hybridization to occur between strands that are nonhomologous, and as a result, background decreases. If the radiolabelled probe is not completely homologous with the immobilized fragment (as is frequently the case in gene family and interspecies hybridization experiments), the hybridization temperature must be reduced, and background will increase. The temperature of the washes affects the intensity of the hybridizing band and the degree of background in a similar manner. The stringency of the washes is also increased with decreasing salt concentrations.

In general, convenient hybridization temperatures in the presence of 50% formamide are 42° C. for a probe with is 95% to 100% homologous to the target fragment, 37° C. for 90% to 95% homology, and 32° C. for 85% to 90% homology. For lower homologies, formamide content should be lowered and temperature adjusted accordingly, using the equation above. If the homology between the probe and the target fragment are not known, the simplest approach is to start with both hybridization and wash conditions which are nonstringent. If non-specific bands or high background are observed after autoradiography, the filter can be washed at high stringency and reexposed. If the time required for exposure makes this approach impractical, several hybridization and/or washing stringencies should be tested in parallel.

Nucleic Acid Probe Assays

Methods such as PCR, branched DNA probe assays, or blotting techniques utilizing nucleic acid probes according to the invention can determine the presence of cDNA or mRNA. A probe is said to "hybridize" with a sequence of the invention if it can form a duplex or double stranded complex, which is stable enough to be detected.

The nucleic acid probes will hybridize to the Chlamydial nucleotide sequences of the invention (including both sense and antisense strands). Though many different nucleotide sequences will encode the amino acid sequence, the native Chlamydial sequence is preferred because it is the actual sequence present in cells. mRNA represents a coding sequence and so a probe should be complementary to the coding sequence; single-stranded cDNA is complementary to mRNA, and so a cDNA probe should be complementary to the non-coding sequence.

The probe sequence need not be identical to the Chlamydial sequence (or its complement)—some variation in the sequence and length can lead to increased assay sensitivity if the nucleic acid probe can form a duplex with target nucleotides, which can be detected. Also, the nucleic acid probe can include additional nucleotides to stabilize the formed duplex. Additional Chlamydial sequence may also be helpful as a label to detect the formed duplex. For example, a non-complementary nucleotide sequence may be attached to the 5' end of the probe, with the remainder of the probe sequence being complementary to a Chlamydial sequence. Alternatively, non-complementary bases or longer sequences can be interspersed into the probe, provided that the probe sequence has sufficient complementarity with the a Chlamydial sequence in order to hybridize therewith and thereby form a duplex which can be detected.

The exact length and sequence of the probe will depend on the hybridization conditions, such as temperature, salt condition and the like. For example, for diagnostic applications, depending on the complexity of the analyte sequence, the nucleic acid probe typically contains at least 10-20 nucleotides, preferably 15-25, and more preferably ≧30 nucleotides, although it may be shorter than this. Short primers generally require cooler temperatures to form sufficiently stable hybrid complexes with the template.

Probes may be produced by synthetic procedures, such as the triester method of Matteucci et al. {*J. Am. Chem. Soc.* (1981) 103:3185}, or according to Urdea et al. {*Proc. Natl. Acad. Sci. USA* (1983) 80: 7461}, or using commercially available automated oligonucleotide synthesizers.

The chemical nature of the probe can be selected according to preference. For certain applications, DNA or RNA are appropriate. For other applications, modifications may be incorporated e.g. backbone modifications, such as phosphorothioates or methylphosphonates, can be used to increase in vivo half-life, alter RNA affinity, increase nuclease resistance etc. {e.g. see Agrawal & Iyer (1995) *Curr Opin Biotechnol* 6:12-19; Agrawal (1996) *TIBTECH* 14:376-387}; analogues such as peptide nucleic acids may also be used {e.g. see Corey (1997) *TIBTECH* 15:224-229; Bucharbt et al. (1993) *TIBTECH* 11:384-386}.

Alternatively, the polymerase chain reaction (PCR) is another well-known means for detecting small amounts of target nucleic acids. The assay is described in: Mullis et al. {*Meth. Enzymol.* (1987) 155: 335-350}; U.S. Pat. Nos. 4,683,195 & 4,683,202. Two 'primers' hybridize with the target nucleic acids and are used to prime the reaction. The primers can comprise sequence that does not hybridize to the sequence of the amplification target (or its complement) to aid with duplex stability or, for example, to incorporate a convenient restriction site. Typically, such sequence will flank the desired Chlamydial sequence.

A thermostable polymerase creates copies of target nucleic acids from the primers using the original target nucleic acids as a template. After a threshold amount of target nucleic acids are generated by the polymerase, they can be detected by more traditional methods, such as Southern blots. When using the Southern blot method, the labelled probe will hybridize to the Chlamydial sequence (or its complement).

Also, mRNA or cDNA can be detected by traditional blotting techniques described in Sambrook et al {supra}. mRNA, or cDNA generated from mRNA using a polymerase enzyme, can be purified and separated using gel electrophoresis. The nucleic acids on the gel are then blotted onto a solid support, such as nitrocellulose. The solid support is exposed to a labelled probe and then washed to remove any unhybridized probe. Next, the duplexes containing the labelled probe are detected. Typically, the probe is labelled with a radioactive moiety.

BRIEF DESCRIPTION OF THE DRAWINGS

FIGS. 1 to 44 show data from examples 1 to 44. Where a figure is of a gel, lane 1 is at the left of the figure.

Figure 1A:
Figure 1B:

For Western Blots, two samples were tested for each protein. The left lane in a pair used membrane strips stained with pre-immune sera whilst the right lane used membrane strips stained with immune sera. In the Western blots in FIGS. 1 to 5, 35B, 37B, 38B and 39, markers are at 66, 45, 30, 20.1 and 14.4 kDa. In the Western blots in FIGS. 6 to 16, 20B, 23C, 24D, 27E, 38A, 40, 41, 42 and 43 markers are at 172.6, 111.4, 79.6, 61.3, 49.0, 36.4, 24.7, 19.2 and 13.1 kDa In the Western Blots in FIGS. 1 to 5, lanes 2 and 3 show control sera raised against GST-fusion control antigens. In the Western blots in FIGS. 1 to 5, lanes 4 and 5 contain control sera raised against His-tagged control antigens.

Low molecular weight markers are run in lane 1 of the purification gels.

MODES FOR CARRYING OUT THE INVENTION

Table I gives the names of *C.pneumoniae* proteins from reference 18, the GenBank accession numbers and titles for those proteins, the GenBank accession numbers and titles for the corresponding *C.trachomatis* proteins of the invention, and SEQ ID numbers (SEQ IDs 1-262, with odd numbers being amino acid sequences and even numbers being nucleotide sequences) for these *C.trachomatis* proteins. These can be expressed and used in the same ways as described in reference 18 for the corresponding *C.pneumoniae* proteins. The *C.trachomatis* proteins are useful for diagnostic and immunogenic purposes. These properties are not evident from the sequence alone.

Various tests can be used to assess the in vivo immunogenicity of the proteins of the invention. For example, the proteins can be expressed recombinantly and used to screen patient sera by immunoblot. A positive reaction between the protein and patient serum indicates that the patient has previously mounted an immune response to the protein in question i.e. the protein is an immunogen. This method can also be used to identify immunodominant proteins.

The recombinant protein can also be conveniently used to prepare antibodies e.g. in a mouse. These can be used for direct confirmation that a protein is located on the cell-surface of *C.trachomatis* (e.g. by using the antibodies in a Western Blot against intact *Chlamydia*). Labelled antibody (e.g. fluorescent labelling for FACS) can be incubated with intact bacteria and the presence of label on the bacterial surface confirms the location of the protein. FACS figures show a scatter profile of the *Chlamydia* preparation used in the assay, the peak shift obtained when antibodies against the recombinant antigen bind to the *Chlamydial* cells (open area=control sample; filled area=antibody-reacted sample), quantitative Kolmogorov-Smirnov (K-S) statistical analysis, and output of the FACS analysis software.

EXAMPLE 1

CT242 (SEQ ID 57 and SEQ D 58) was expressed in *E.coli*. The recombinant product was purified both as a GST-fusion protein (FIG. 1A; lanes 4 and 5, chromatography fractions 1 and 2, expected molecular weight 42.4 kDa) and as a His-tagged fusion protein (FIG. 1B; lanes 2-4, chromatography fractions 1, 2 and 3, expected molecular weight 16.4 kDa).

Figure 1C:
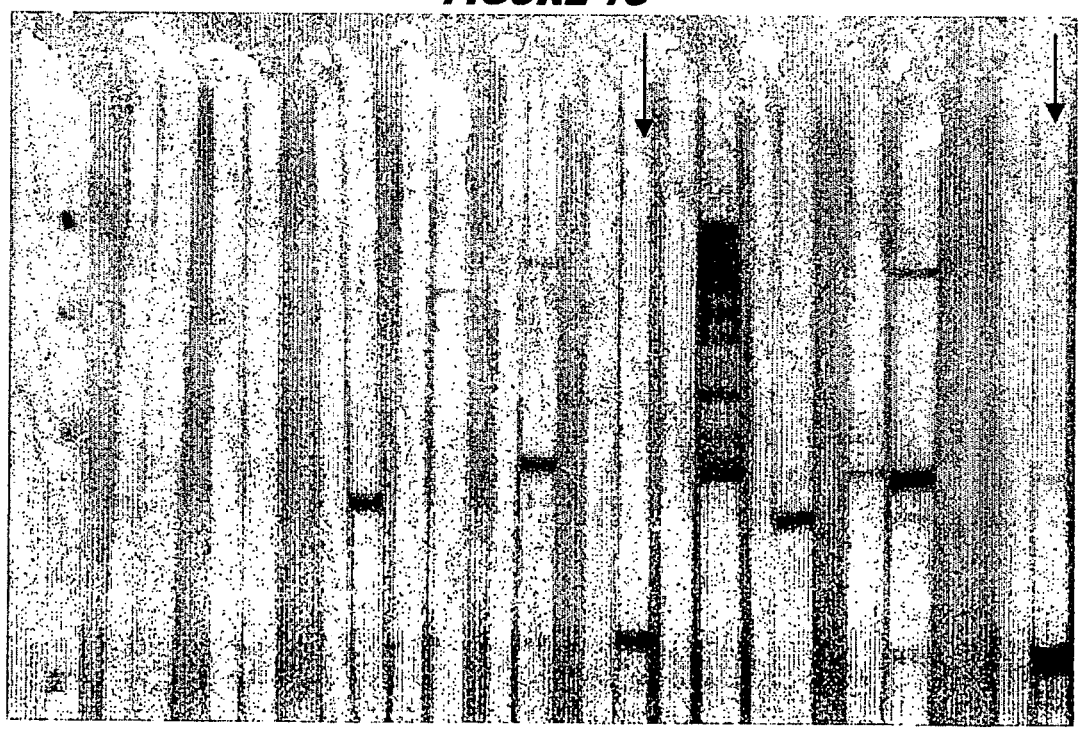

The recombinant protein was used to immunise mice, whose sera were used in a Western blot (FIG. 1C: His-tagged: lanes 12 and 13; GST-fusion: lanes 20 and 21). Lane 12 shows membrane strips stained with pre-immune sera for His-tagged CT242 whilst lane 13 shows membrane strips stained with immune sera for His-tagged CT242. Lane 20 shows membrane strips stained with preimmune sera for GST-fusion CT242 whilst lane 21 shows membrane strips stained with immune sera for GST-fusion CT242.

These experiments show that CT242 is a surface-exposed and immunoaccessible protein, and that it is a useful immunogen. These properties are not evident from the sequence alone.

EXAMPLE 2

CT045 (SEQ ID 71 and SEQ ID 72) was expressed in *E.coli*. The recombinant product was purified as a His-tagged fusion protein (FIG. 2A; lanes 4-6, chromatography fractions 1, 2 and 3, expected molecular weight 55.8 kDa).

The recombinant protein was used to immunise mice, whose sera were used in a Western blot (FIG. 2B, lanes 8 and 9) and for FACS analysis (FIG. 2C, K-S value 16.81).

These experiments show that CT045 is a surface-exposed and immunoaccessible protein, and that it is a useful immunogen. These properties are not evident from the sequence alone.

EXAMPLE 3

Figure 3D:
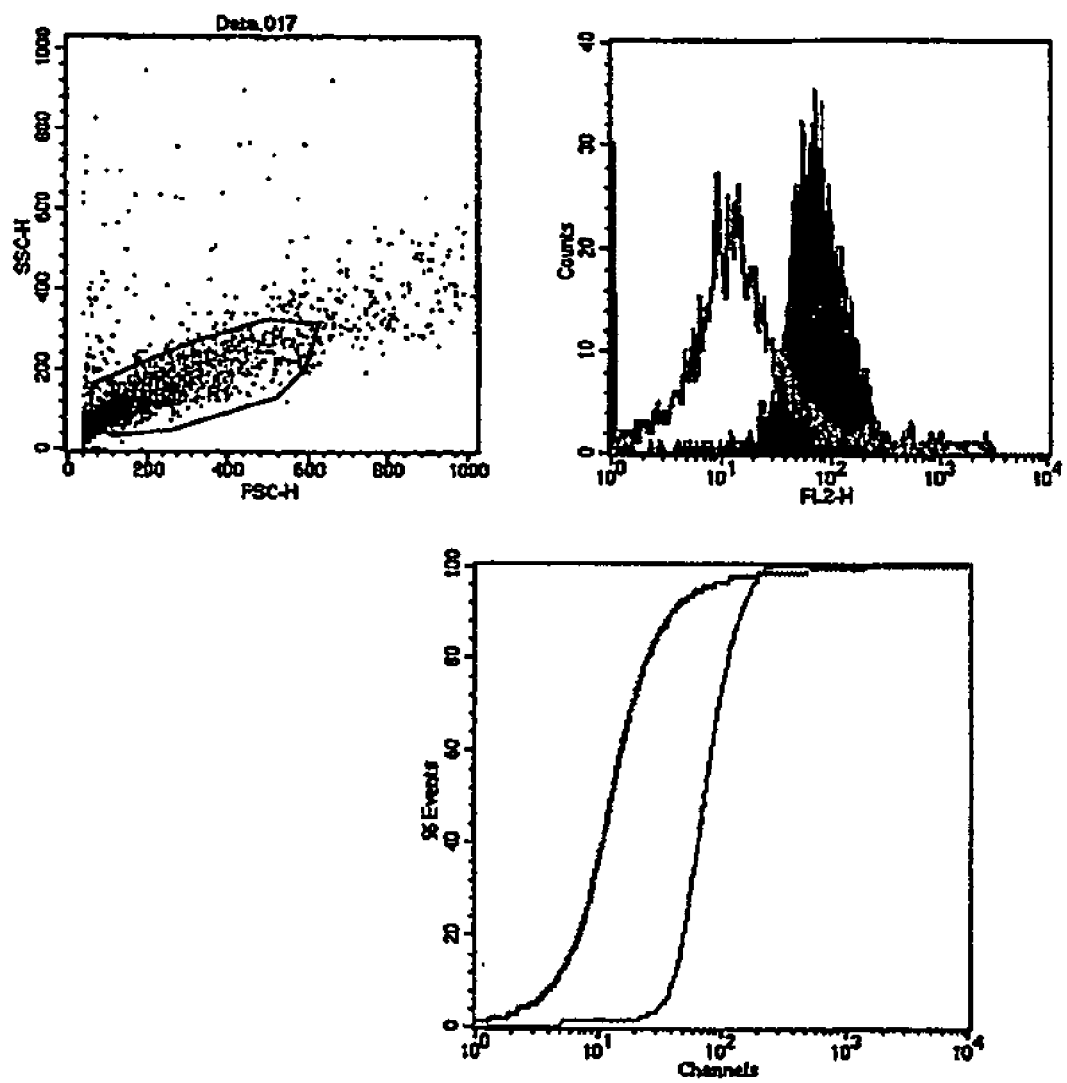

CT381 (SEQ ID 105 and SEQ ID) 106) was expressed in *E.coli*. The recombinant product was purified both as a GST-fusion protein (FIG. 3A; lanes 2 and 3, chromatography fractions 1 and 2, expected molecular weight 52.7 kDa) and as a His-tagged fusion protein (FIG. 3A; lanes 7-9, chromatography fractions 1, 2 and 3, expected molecular weight 26.7 kDa). The recombinant protein was used to immunise mice, whose sera were used in a Western blot (FIG. 3B: His-tagged: lanes 6 and 7; GST-fusion: lanes 16 and 17) and for FACS analysis (FIG. 3C: GST-tagged, K-S value 35.98; FIG. 3D: His-tagged, K-S value 32.54).

These experiments show that CT381 is a surface-exposed and immunoaccessible protein, and that it is a useful immunogen. These properties are not evident from the sequence alone.

EXAMPLE 4

Figure 4A:
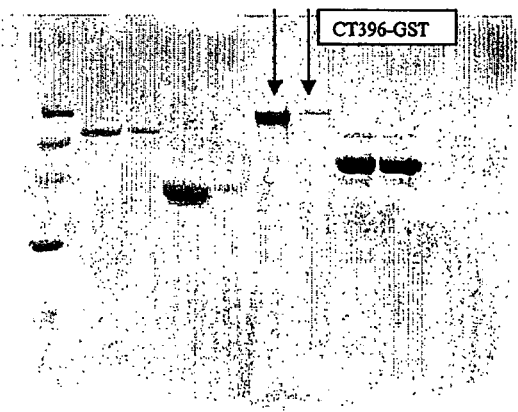
Figure 4B:
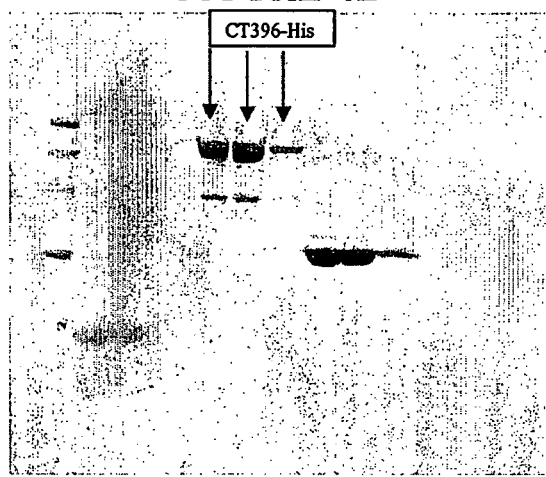
Figure 4C:
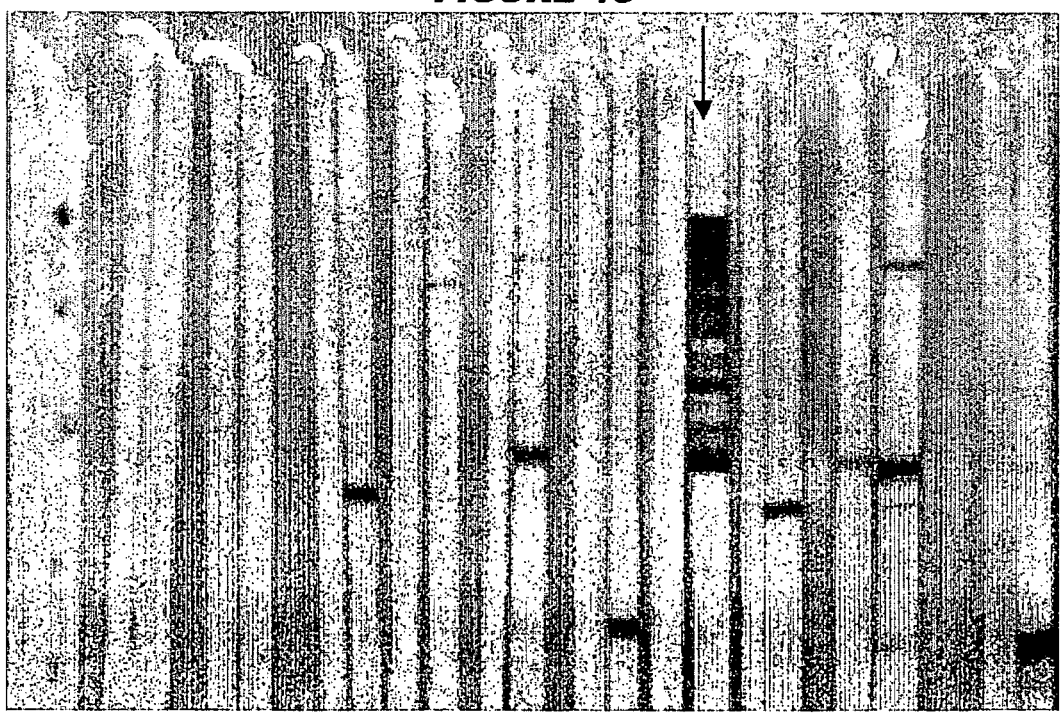
Figure 4D:
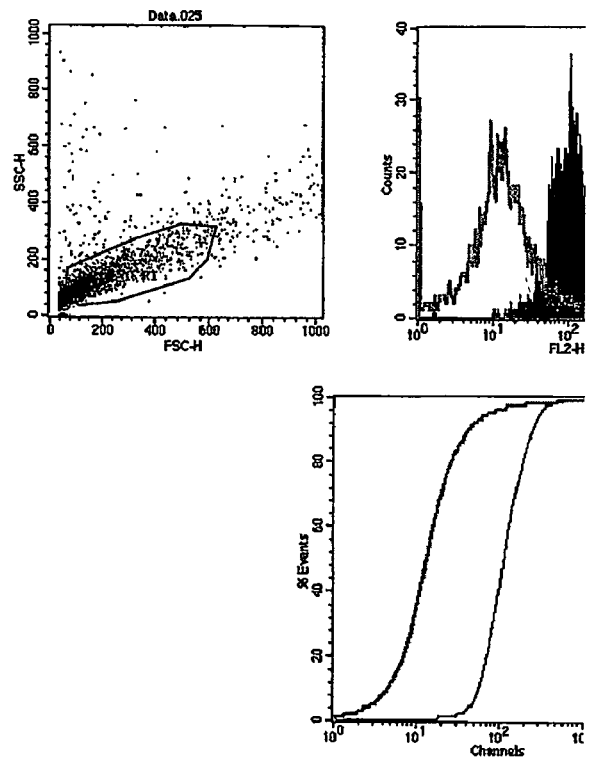
Figure 4E:
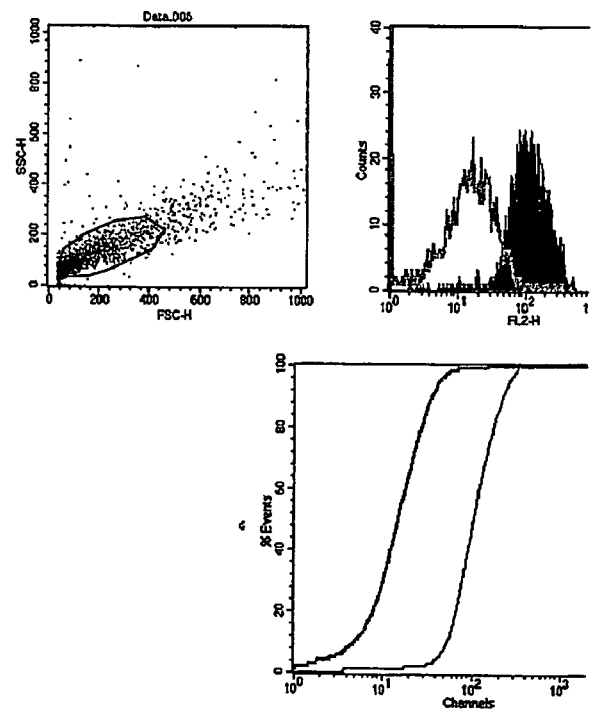

CT396 (SEQ ID 107 and SEQ ID 108) was expressed in *E.coli*. The recombinant product was purified both as a GST-fusion protein (FIG. 4A; lanes 6 and 7, chromatography fractions 1 and 2, expected molecular weight 99.5 kDa) and as a His-tagged fusion protein (FIG. 4B; lanes 5-7, chromatography fractions 1, 2 and 3, expected molecular weight 73.5 kDa). The recombinant His-tagged protein was used to immunise mice, whose sera were used in a Western blot (FIG. 4C, lanes 14 and 15). The recombinant His-tagged protein and GST-fusion protein were also used for FACS analysis (FIG. 4D: His-tagged, K-S value 34.50; FIG. 4E: GST-fusion, K-S value 32.76).

These experiments show that CT396 is a surface-exposed and immunoaccessible protein, and that it is a useful immunogen. These properties are not evident from the sequence alone.

EXAMPLE 5

Figure 5A:
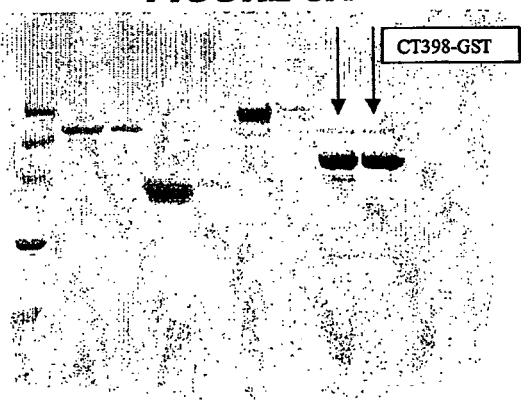
Figure 5B:
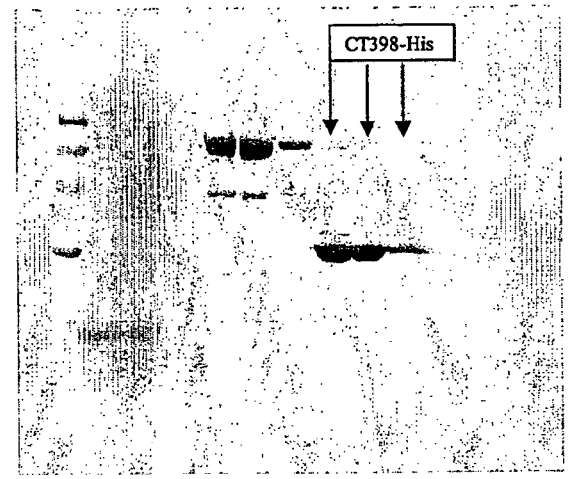
Figure 5C:
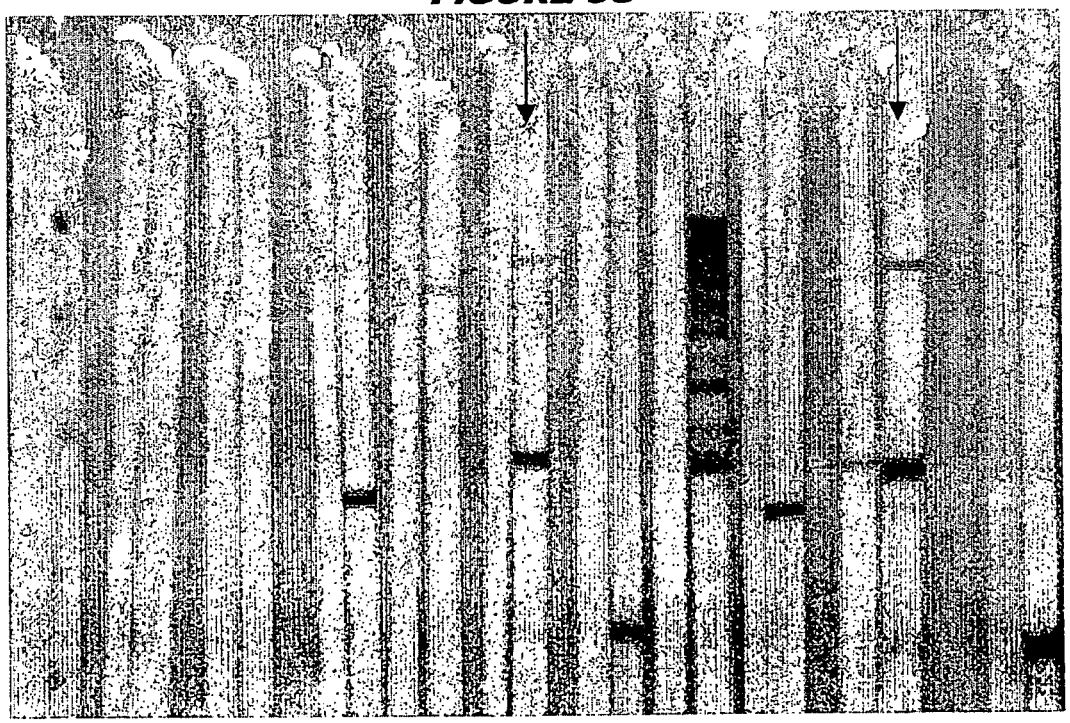
Figure 5D:
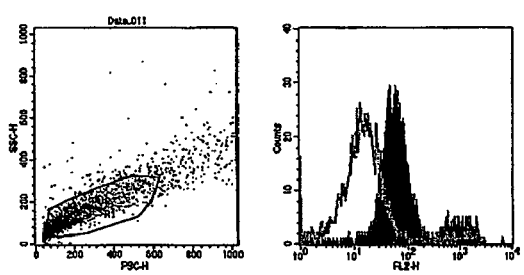
Figure 5D:
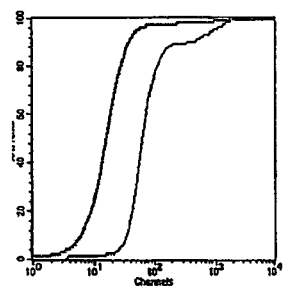
Figure 5E:
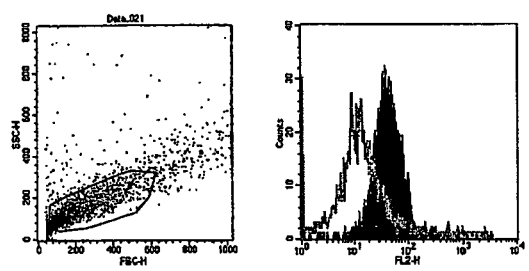
Figure 5E:
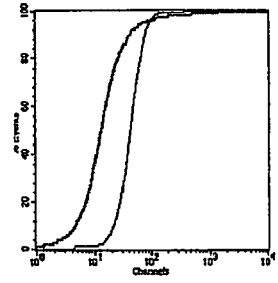
Figure 6A:
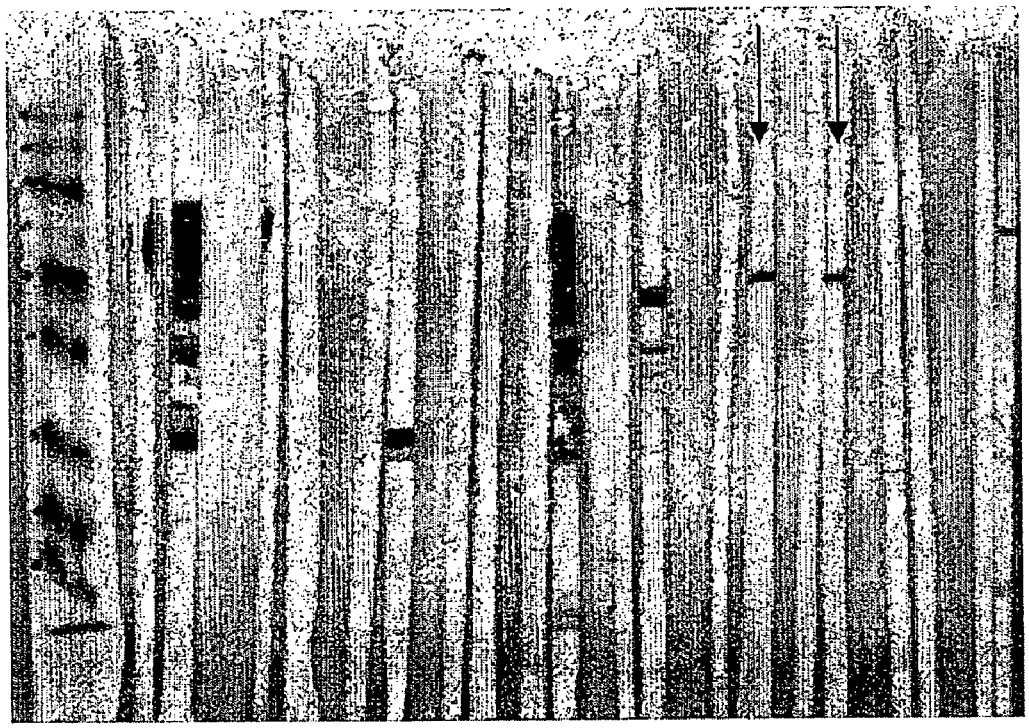
Figure 6B:
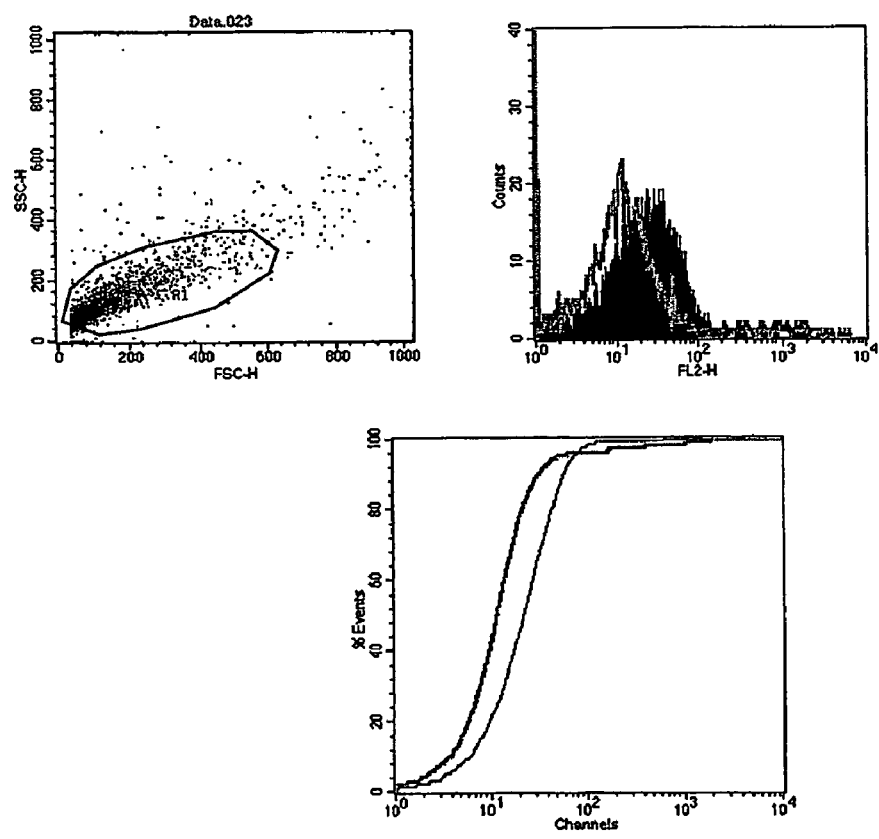
Figure 6C:
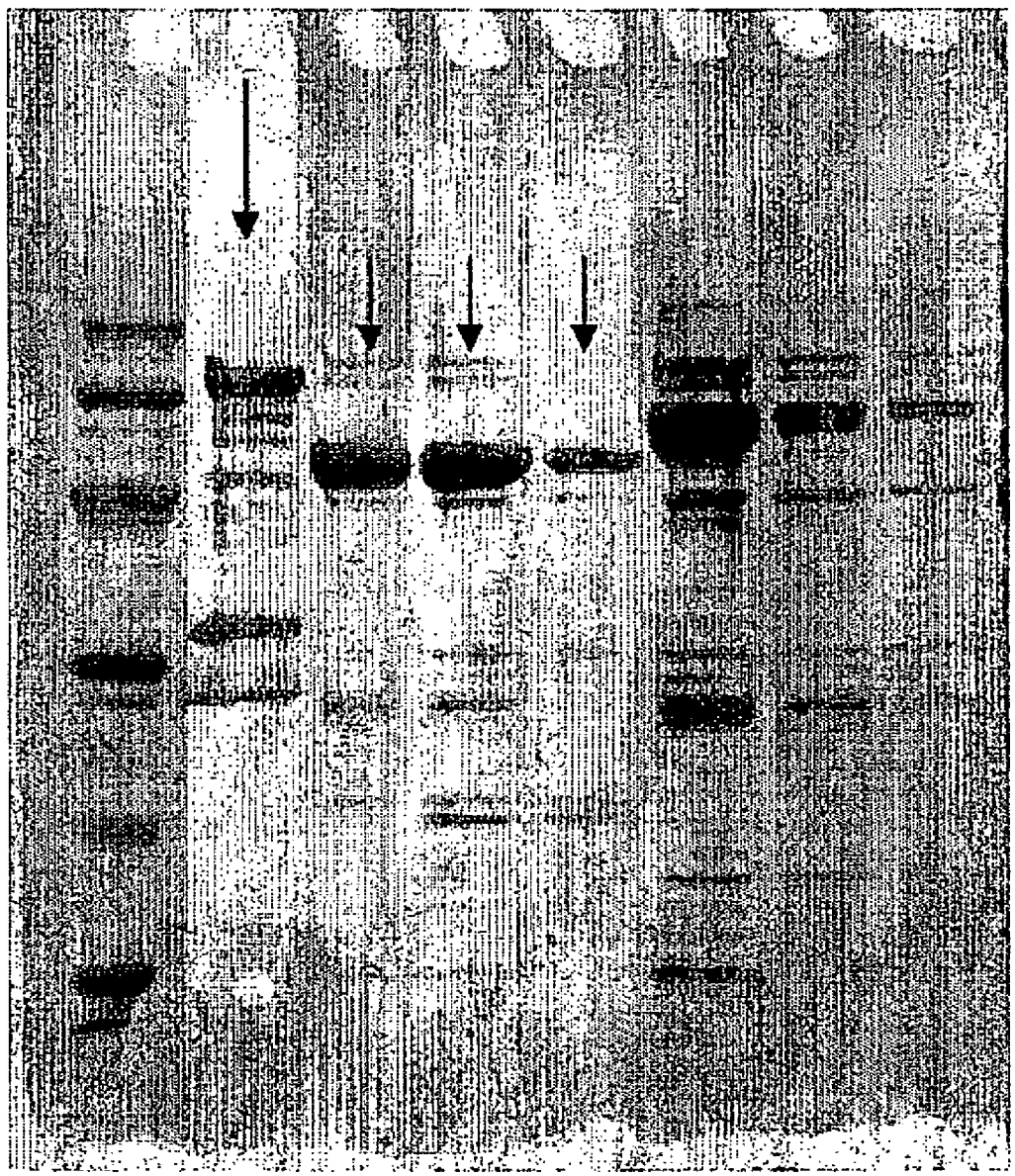
Figure 7A:
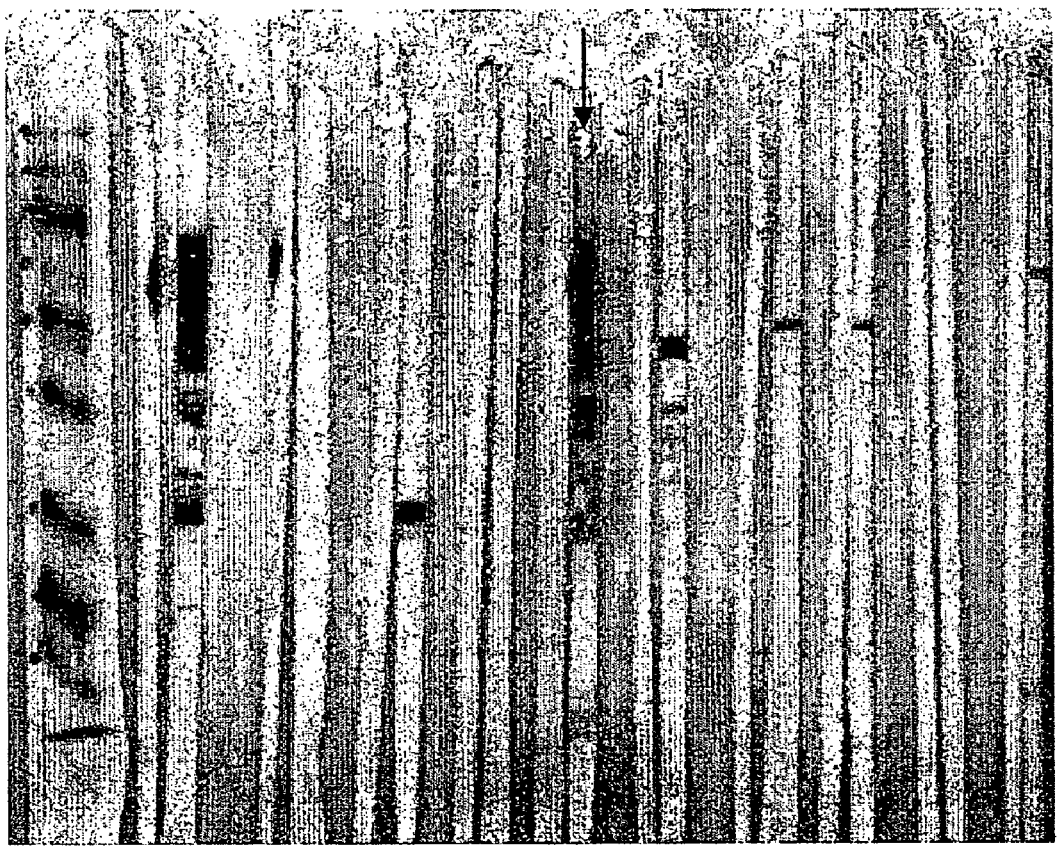
Figure 7B:
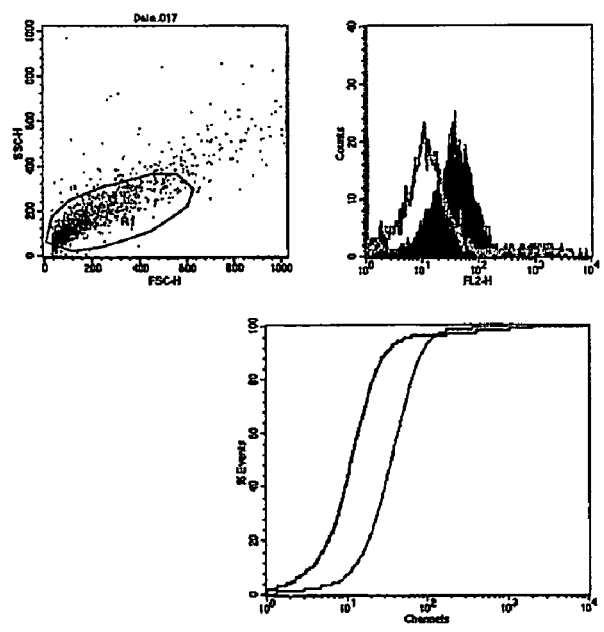
Figure 8A:
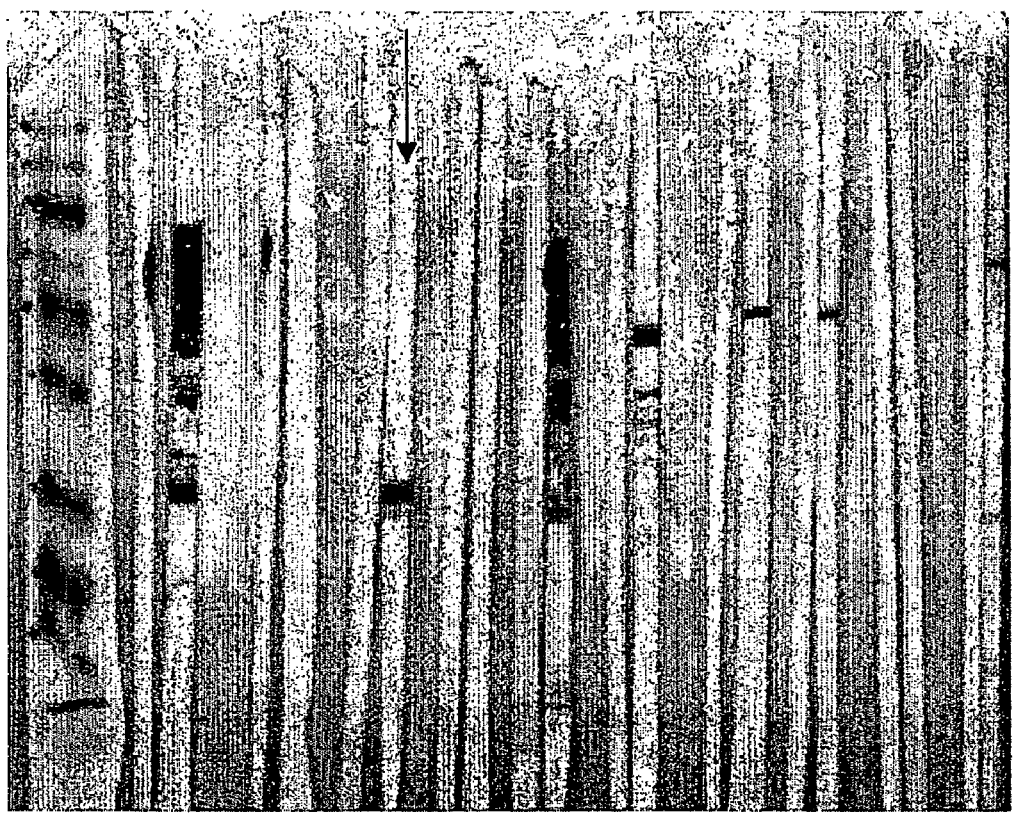
Figure 8B:
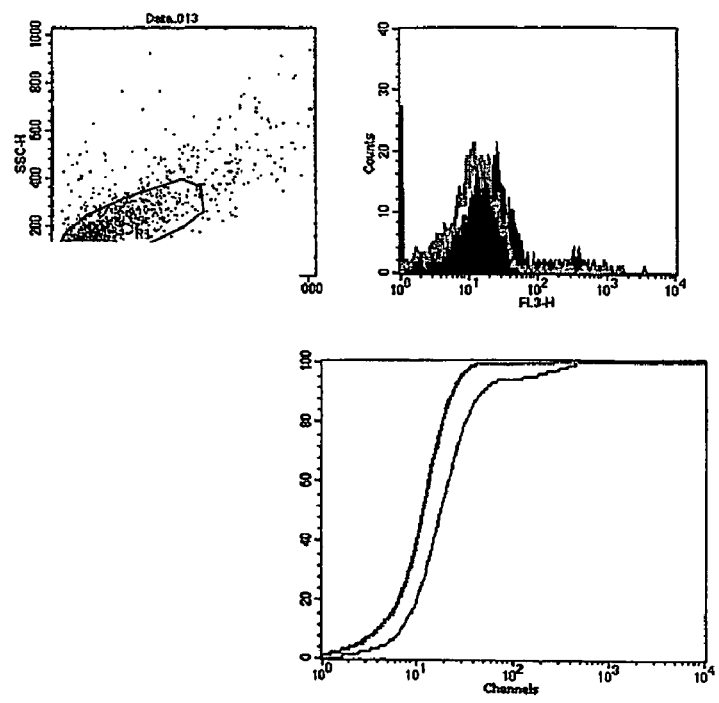
Figure 8C:
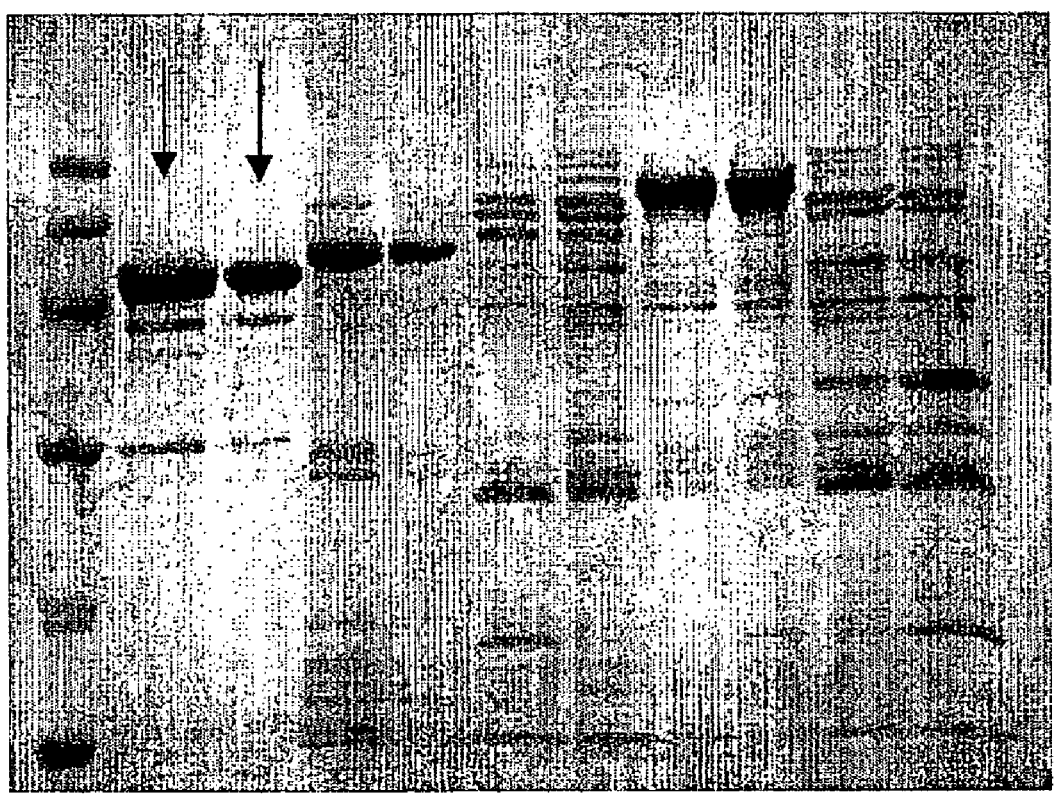

30 CT398 (SEQ ID 111 and SEQ ID 112) was expressed in *E.coli*. The recombinant product was purified both as a GST-fusion protein (FIG. 5A; lanes 8 and 9, chromatography fractions 1 and 2, expected molecular weight 54.8 kDa) and as a His-tagged fusion protein (FIG. 5B; lanes 8-10, chromatography fractions 1, 2 and 3, expected molecular weight 28.8 kDa). The recombinant protein was used to immunise mice, whose sera were used in a Western blot (FIG. 5C: His-tagged: lanes 10 and 11; GST-fusion: lanes 18 and 19) and for FACS analysis (FIG. 5D: GST-fusion, K-S value 31.24; FIG. 5E: His-tagged, K-S value 26.10).

These experiments show that CT398 is a surface-exposed and immunoaccessible protein, and that it is a useful immunogen. These properties are not evident from the sequence alone.

EXAMPLE 6

CT089 (SEQ ID 61 and SEQ ID 62) was expressed in *E.coli*. The recombinant product was purified both as a GST-fusion protein (FIG. 6C: lane 2, chromatography fraction 1, expected molecular weight 70.8 kDa) and as a His-tagged fusion protein (FIG. 6C: lanes 3, 4 and 5, chromatography fractions 1, 2 and 3, expected molecular weight 44.8 kDa). The recombinant proteins were used to immunise mice, whose sera were used in a Western blot (FIG. 6A: GST-fusion: lanes 14 and 15; His-tagged: lanes 16 and 17) and for FACS analysis (FIG. 6B: His-tagged, K-S value 26.59).

These experiments show that CT089 is a surface-exposed and immunoaccessible protein, and that it is a useful immunogen. These properties are not evident from the sequence alone.

EXAMPLE 7

CT443 (SEQ ID 125 and SEQ ID 126) was expressed in *E.coli*. The recombinant product was purified as a His-tagged fusion protein. The recombinant protein was used to immunise mice, whose sera were used in a Western blot (FIG. 7A: lanes 10 and 11) and for FACS analysis (FIG. 7B: K-S value 21.28).

These experiments show that CT443 is a surface-exposed and immunoaccessible protein, and that it is a useful immunogen. These properties are not evident from the sequence alone.

EXAMPLE 8

CT541 (SEQ ID 149 and SEQ ID 150) was expressed in *E.coli*. The recombinant product was purified as a GST-fusion protein (FIG. 8C: lanes 2 and 3, chromatography fractions 1 and 2, expected molecular weight 51.6 kDa). The recombinant protein was used to immunise mice, whose sera were used in a Western blot (FIG. 8A: lanes 6 and 7) and for FACS analysis (FIG. 8B: K-S value 9.94).

These experiments show that CT541 is a surface-exposed and immunoaccessible protein, and that it is a useful immunogen. These properties are not evident from the sequence alone.

EXAMPLE 9

Figure 9A:
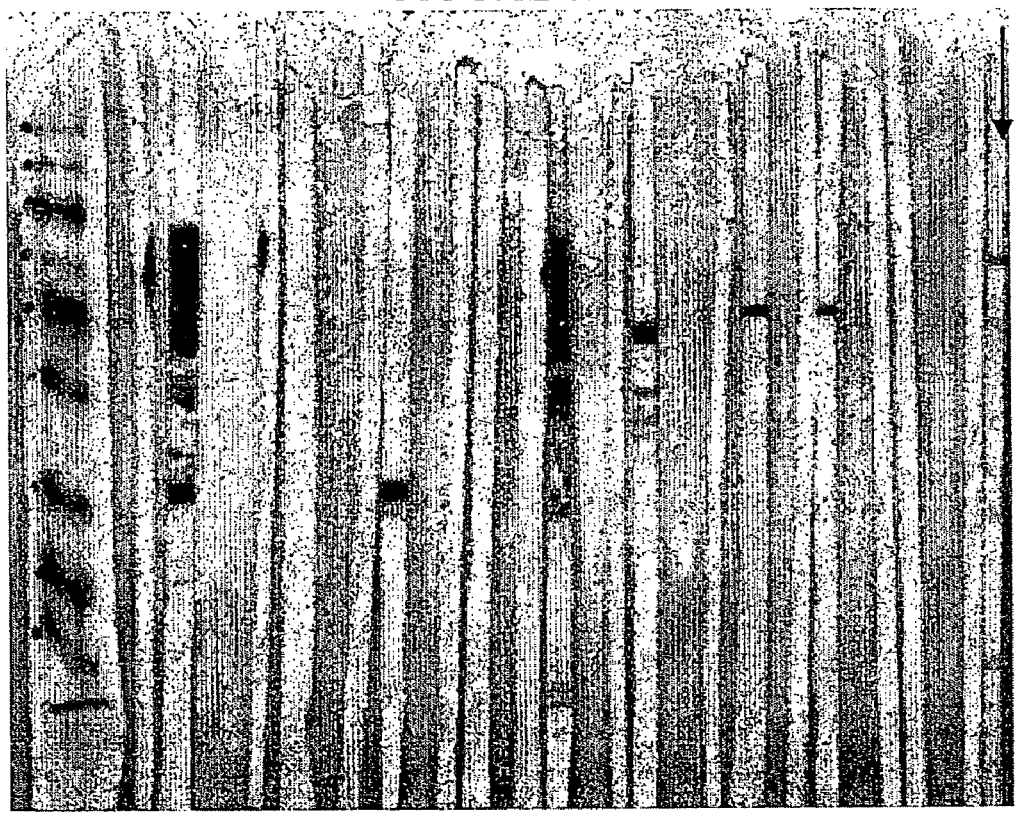
Figure 9B:
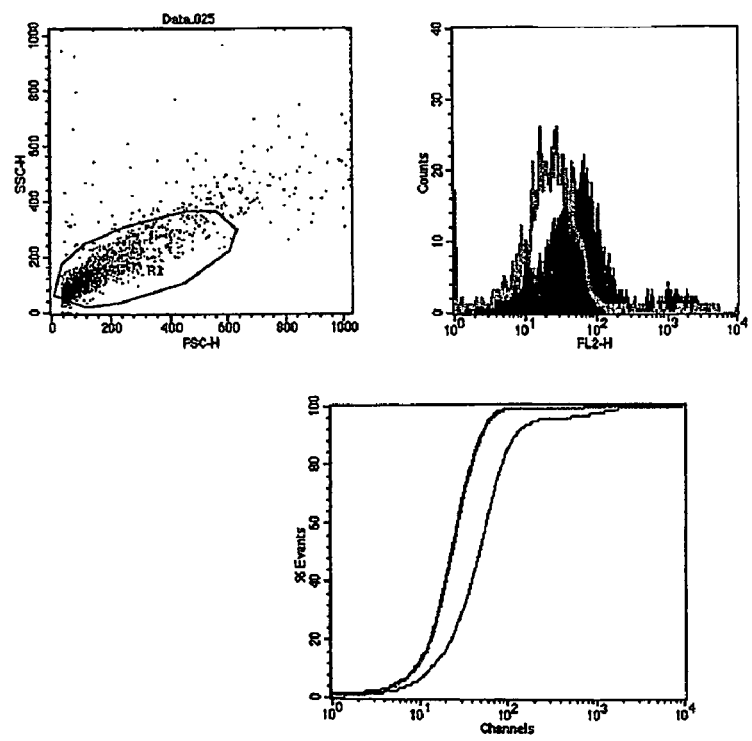
Figure 9C:
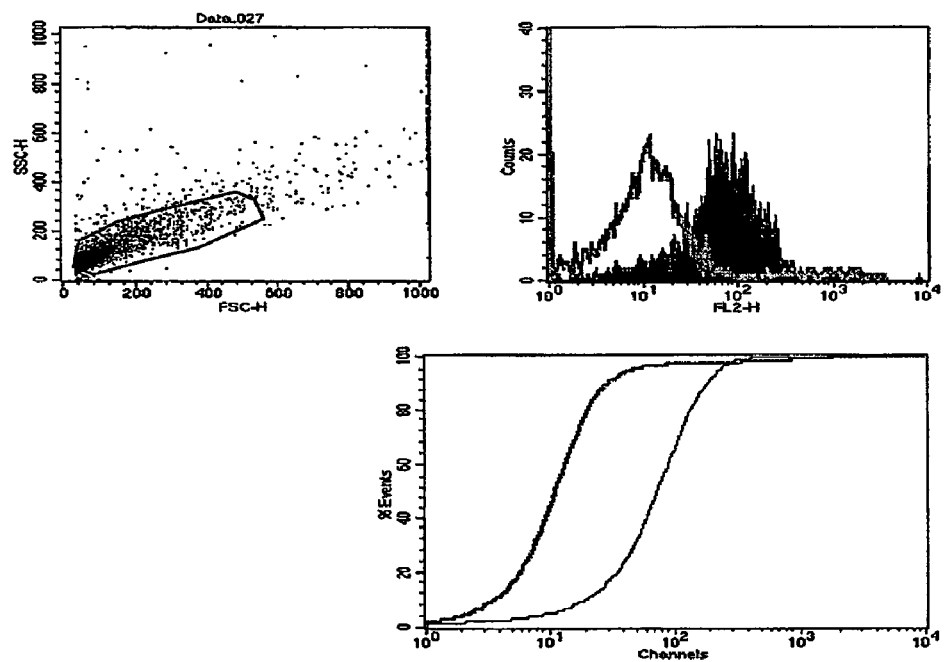
Figure 9D:
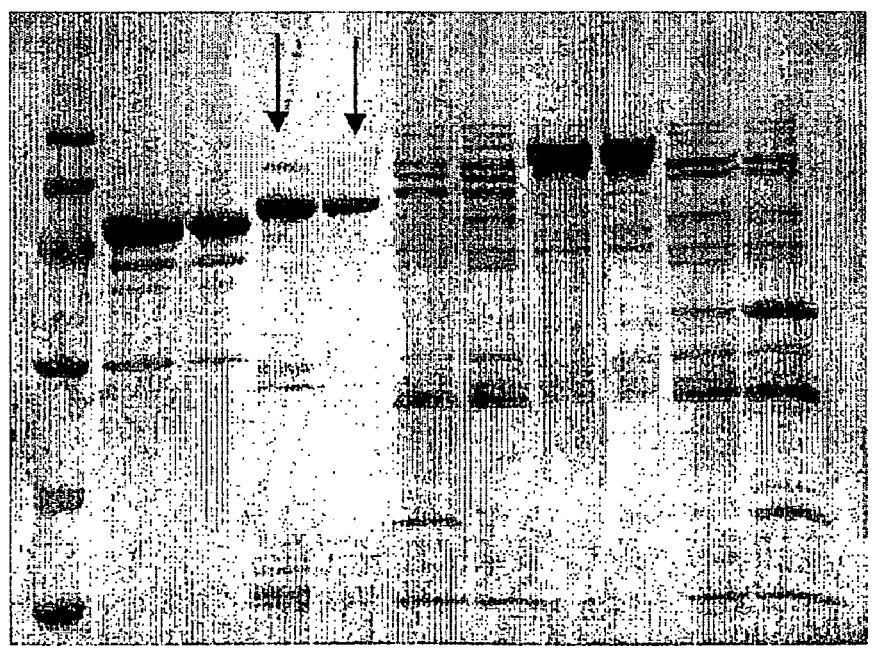
Figure 10A:
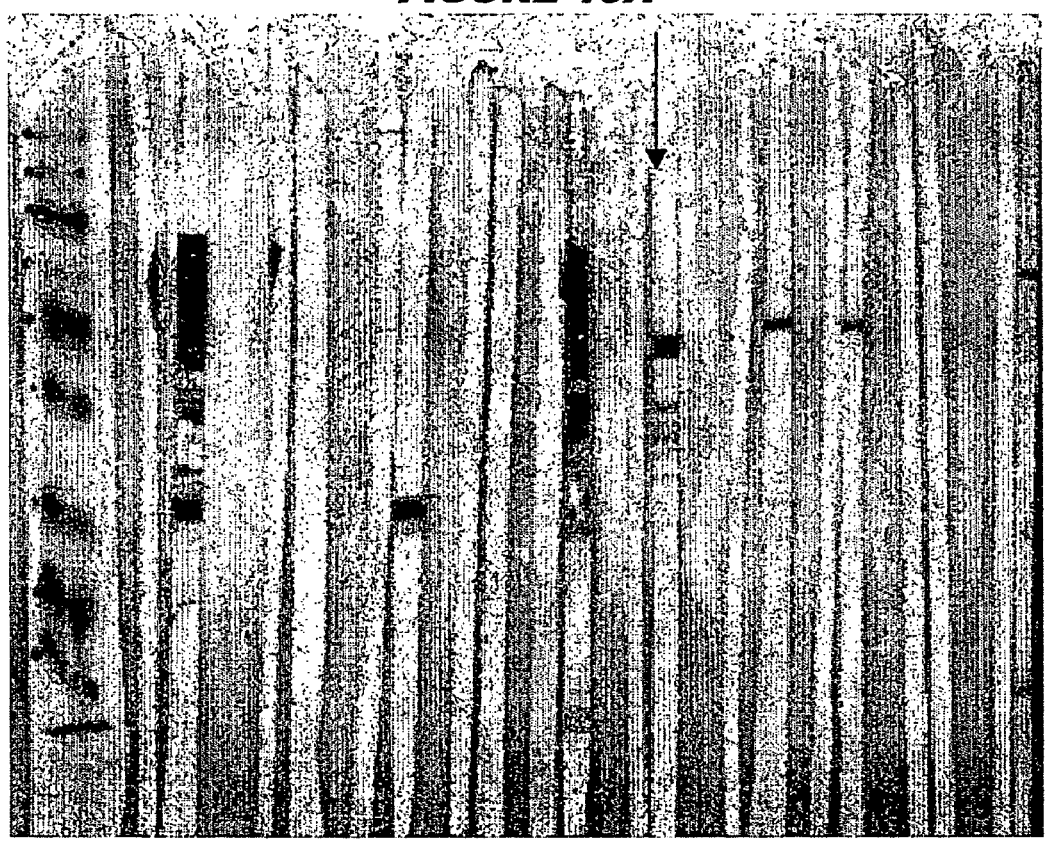
Figure 10B:
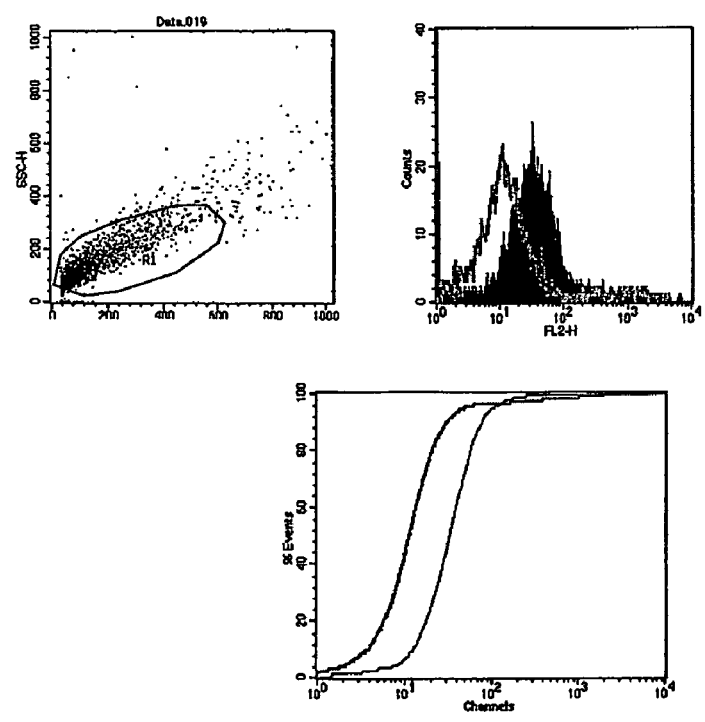
Figure 10C:
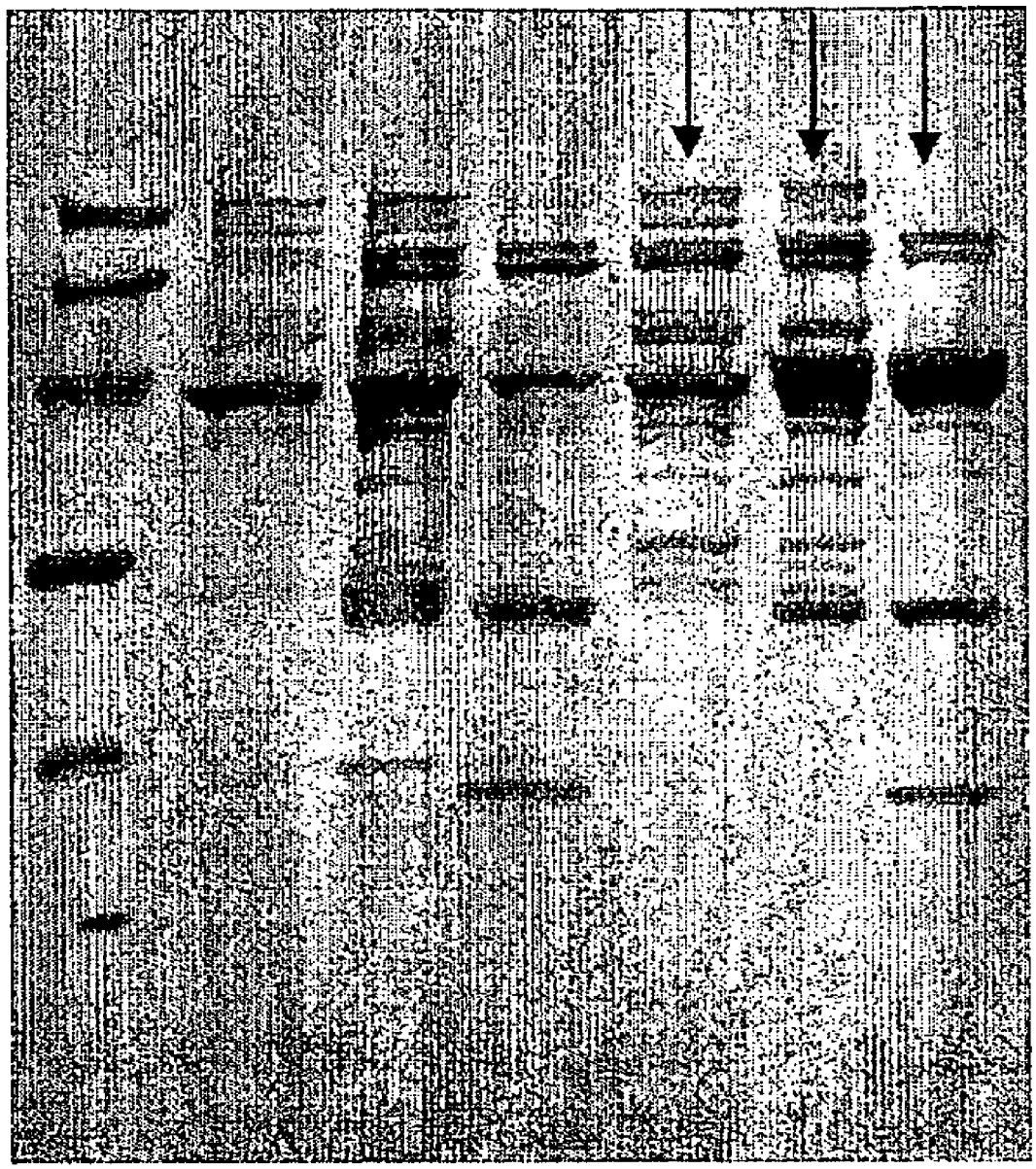
Figure 11A:
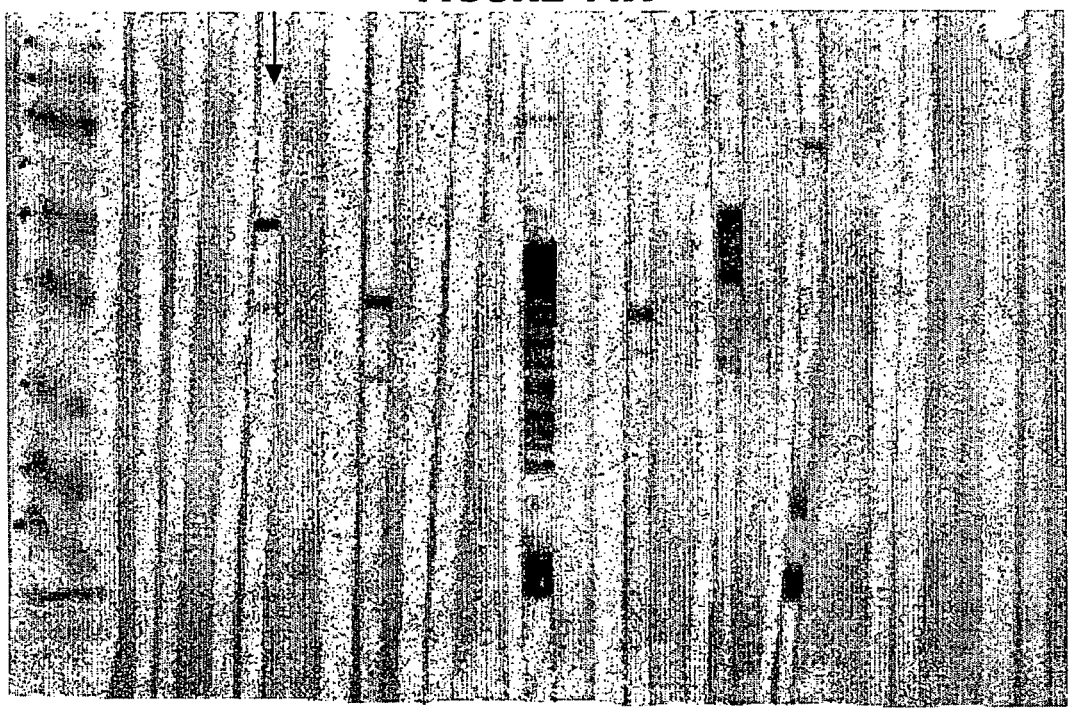
Figure 11B:
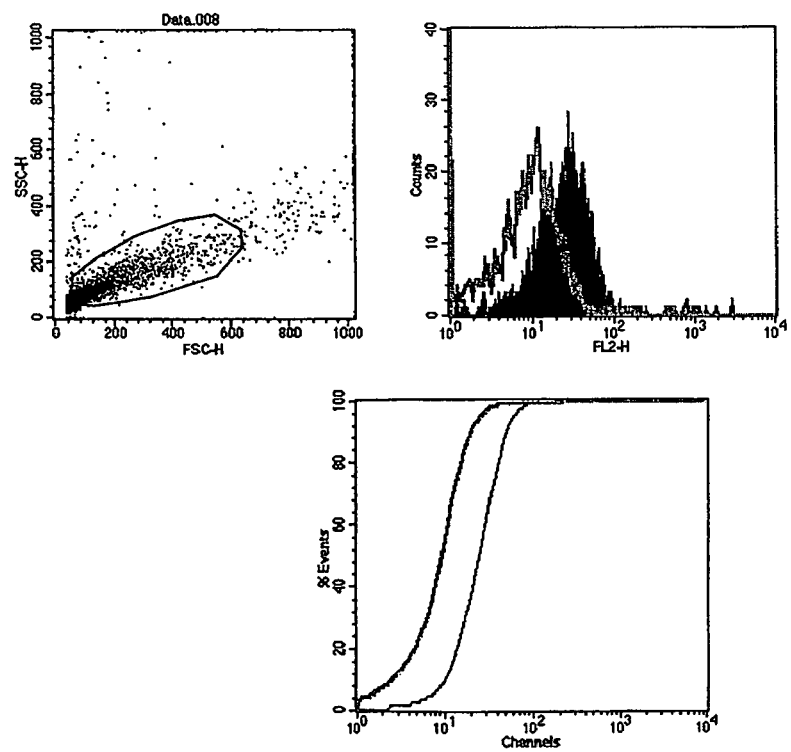
Figure 11C:
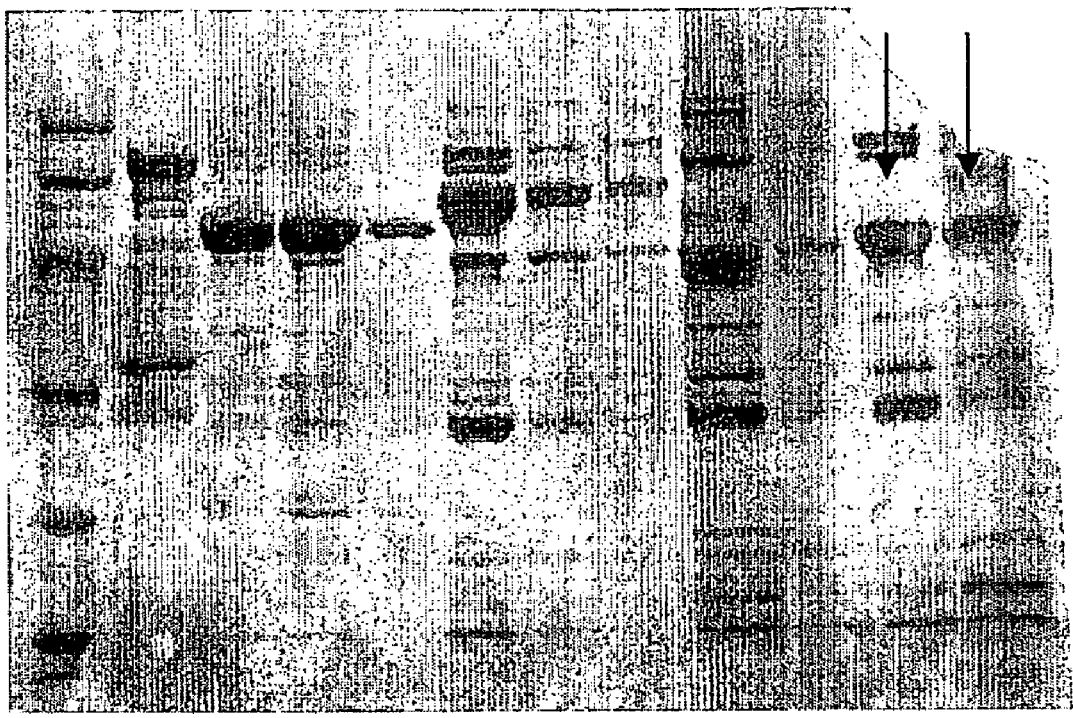

CT547 (SEQ ID 151 and SEQ ID 152) was expressed in *E.coli*. The recombinant product was purified both as a GST-fusion protein (FIG. 9D: lanes 4 and 5, chromatography fractions 1 and 2, expected molecular weight 58.3 kDa) and as a His-tagged fusion protein. The recombinant protein was used to immunise mice, whose sera were used in a Western blot (FIG. 9A: His-tagged: lanes 20 and 21) and for FACS analysis (FIG. 9B: GST-fusion, K-S values 14.60 and 15.57; FIG. 9C: His-tagged, K-S value 28.21).

These experiments show that CT547 is a surface-exposed and immunoaccessible protein, and that it is a useful immunogen. These properties are not evident from the sequence alone.

EXAMPLE 10

CT587 (SEQ ID 189 and SEQ ID 190) was expressed in *E.coli*. The recombinant product was purified as a His-tagged fusion protein (FIG. 10C: lanes 5, 6 and 7, chromatography fractions 1, 2 and 3, expected molecular weight 47.5 kDa). The recombinant protein was used to immunise mice, whose sera were used in a Western blot (FIG. 10A: lanes 12 and 13) and for FACS analysis (FIG. 10B: His-tagged, K-S value 20.85).

These experiments show that CT587 is a surface-exposed and immunoaccessible protein, and that it is a useful immunogen. These properties are not evident from the sequence alone.

EXAMPLE 11

CT266 (SEQ ID 77 and SEQ ID 78) was expressed in *E.coli*. The recombinant product was purified as a His-tagged fusion protein (FIG. 11C: lanes 11 and 12, chromatography fractions 1 and 2, expected molecular weight 44.1 kDa). The recombinant protein was used to immunise mice, whose sera were used in a Western blot (FIG. 11A: lanes 4 and 5) and for FACS analysis (FIG. 11B: K-S value 21.29).

These experiments show that CT266 is a surface-exposed and immunoaccessible protein, and that it is a useful immunogen. These properties are not evident from the sequence alone.

EXAMPLE 12

Figure 12A:
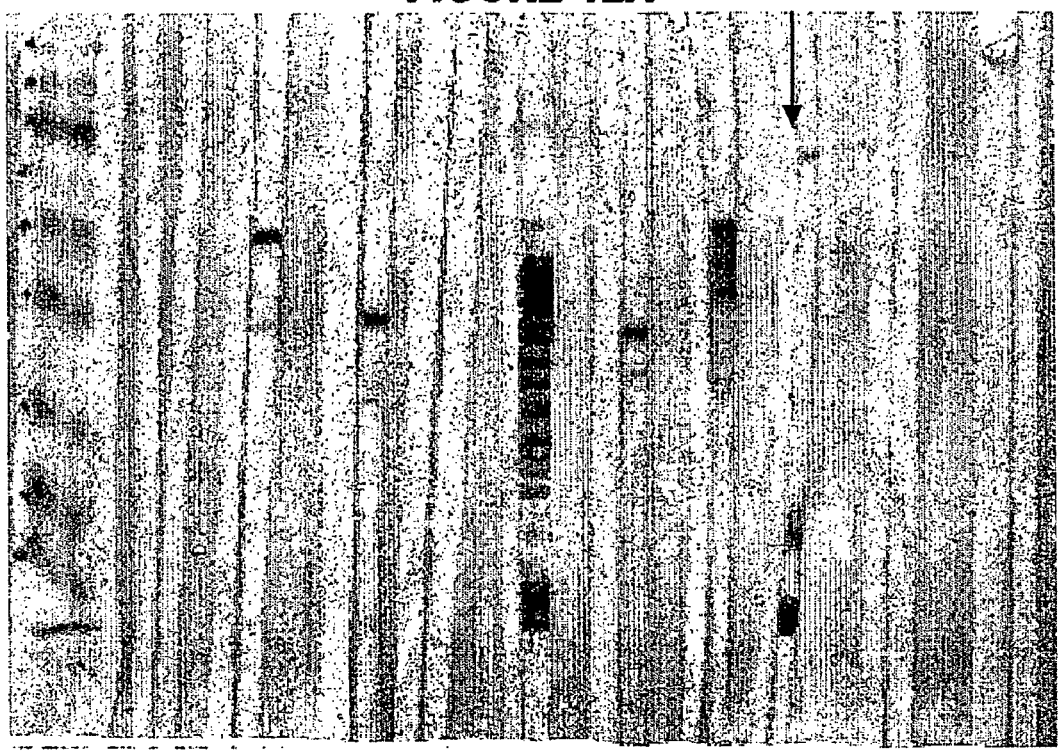
Figure 12B:
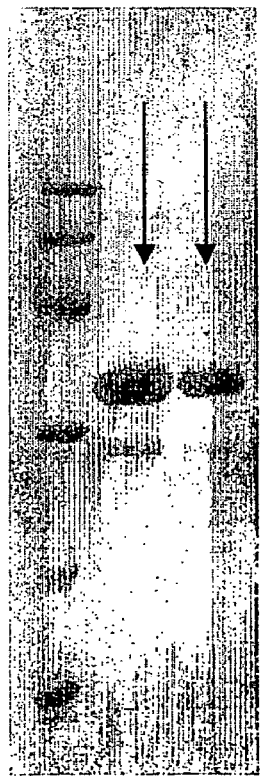
Figure 12C:
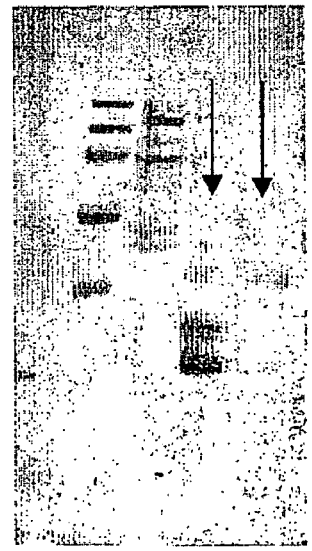
Figure 12D:
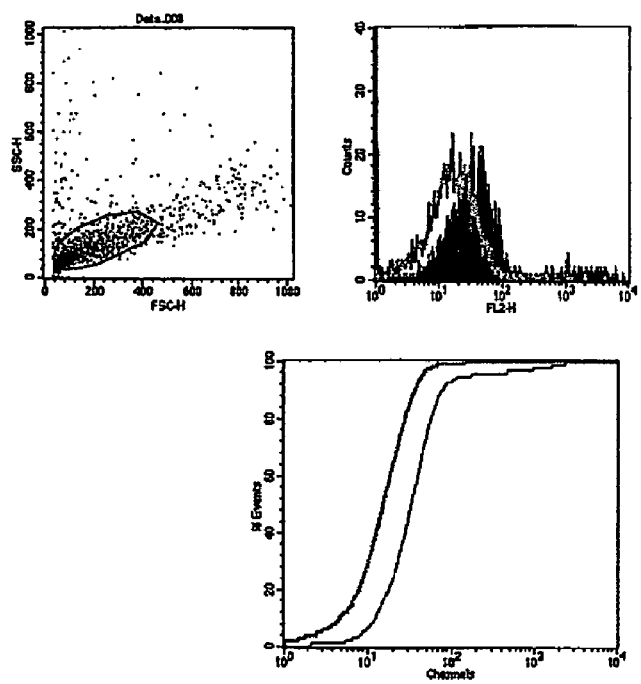
Figure 12E:
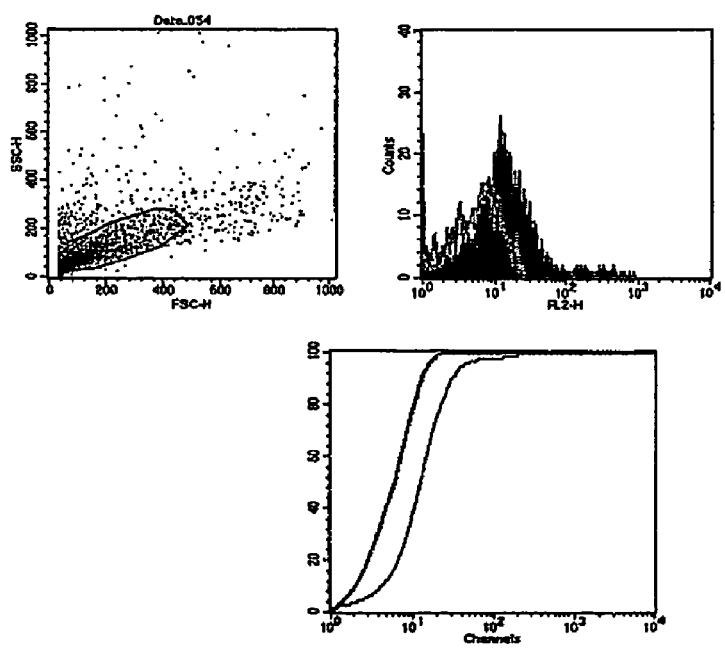
Figure 13A:
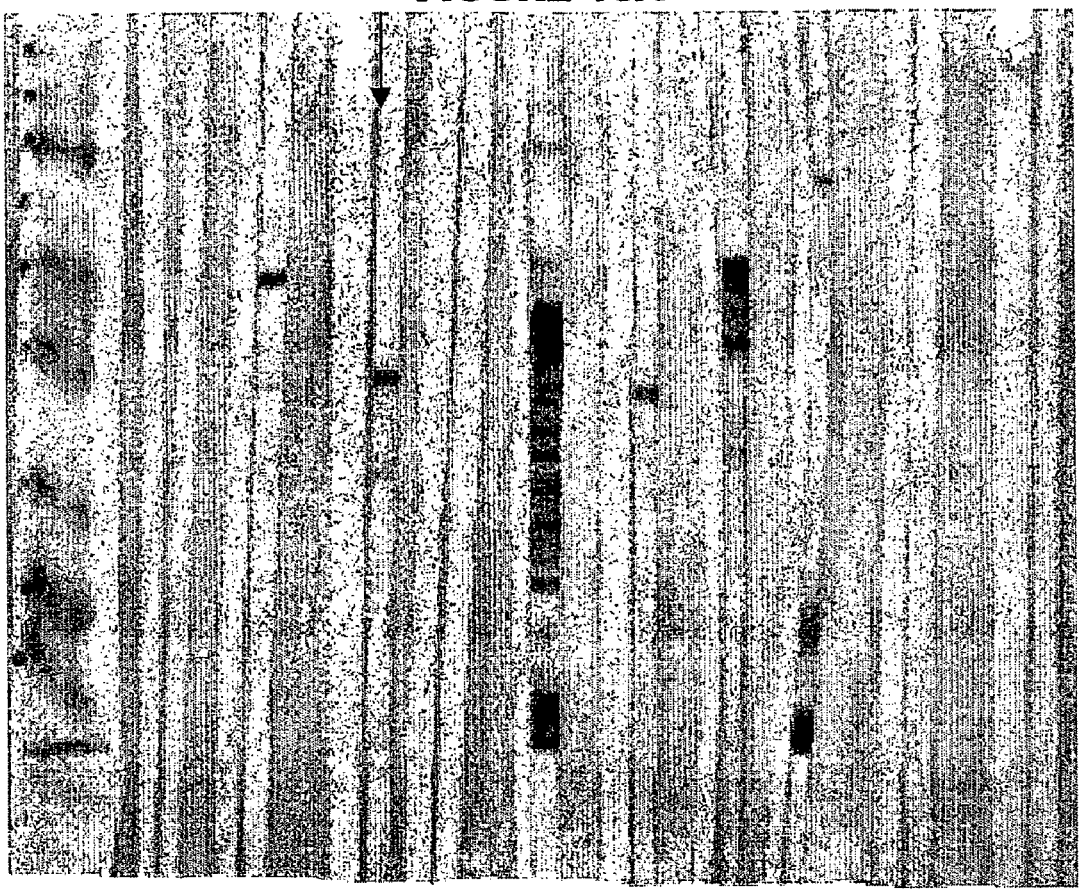
Figure 13B:
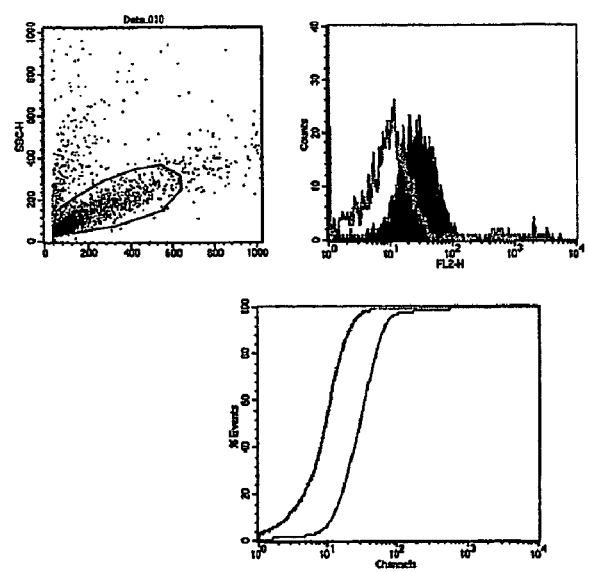
Figure 13C:
Figure 14A:
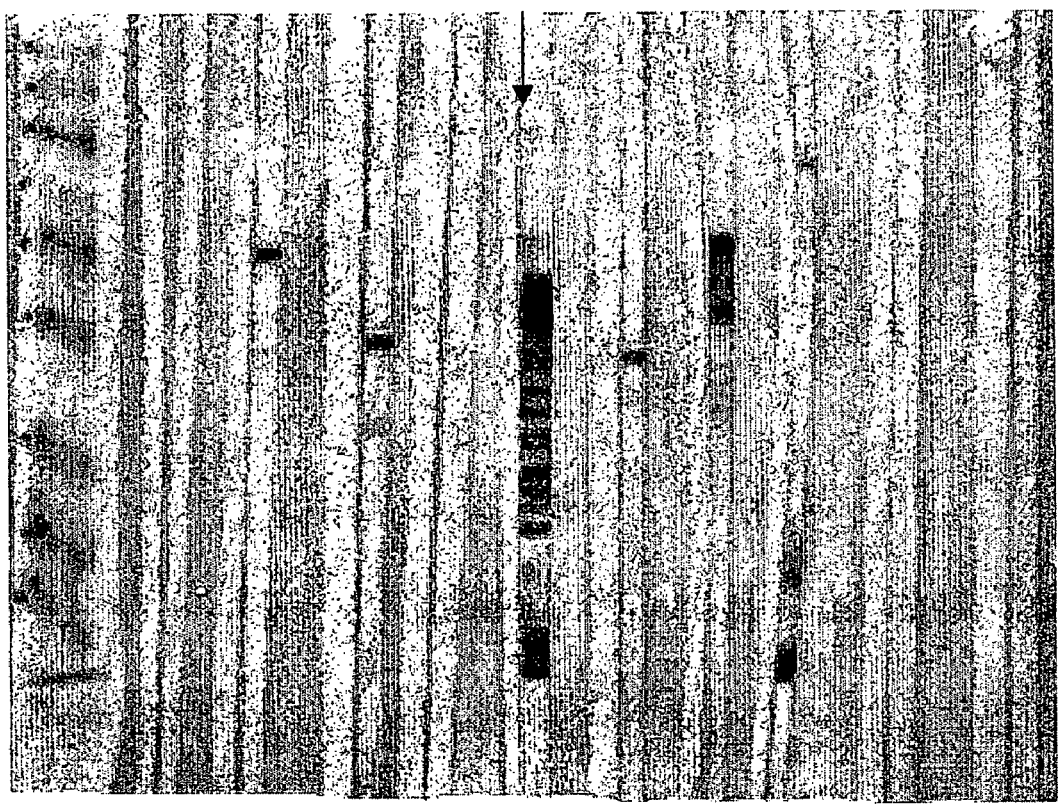
Figure 14B:
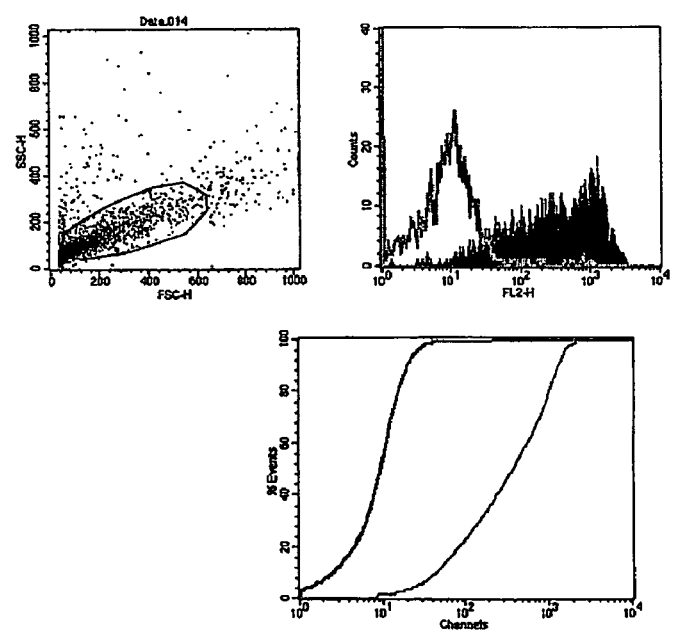
Figure 14C:
Figure 15A:
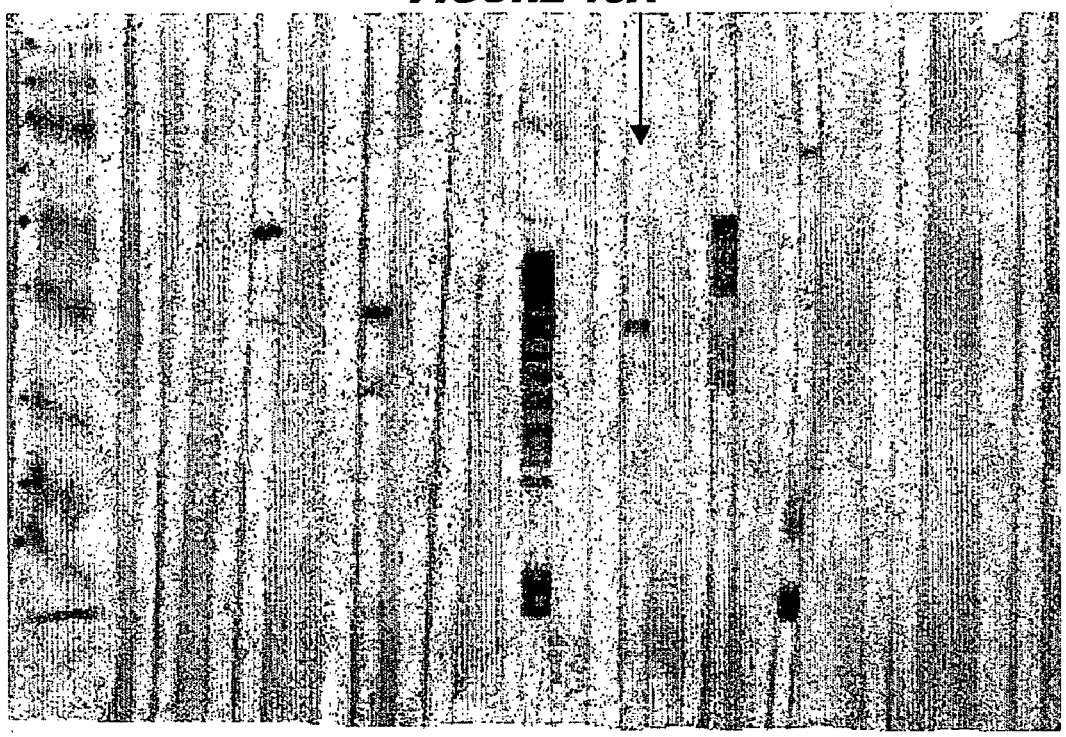
Figure 15B:
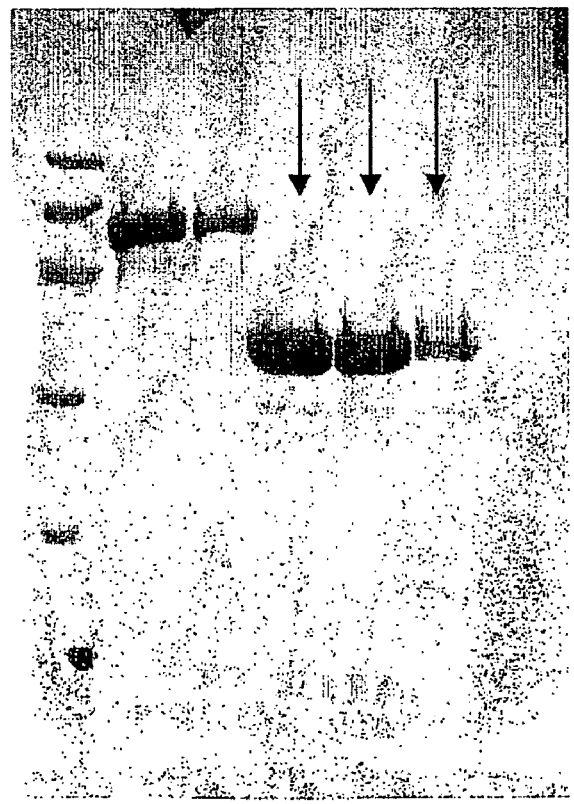
Figure 15C:
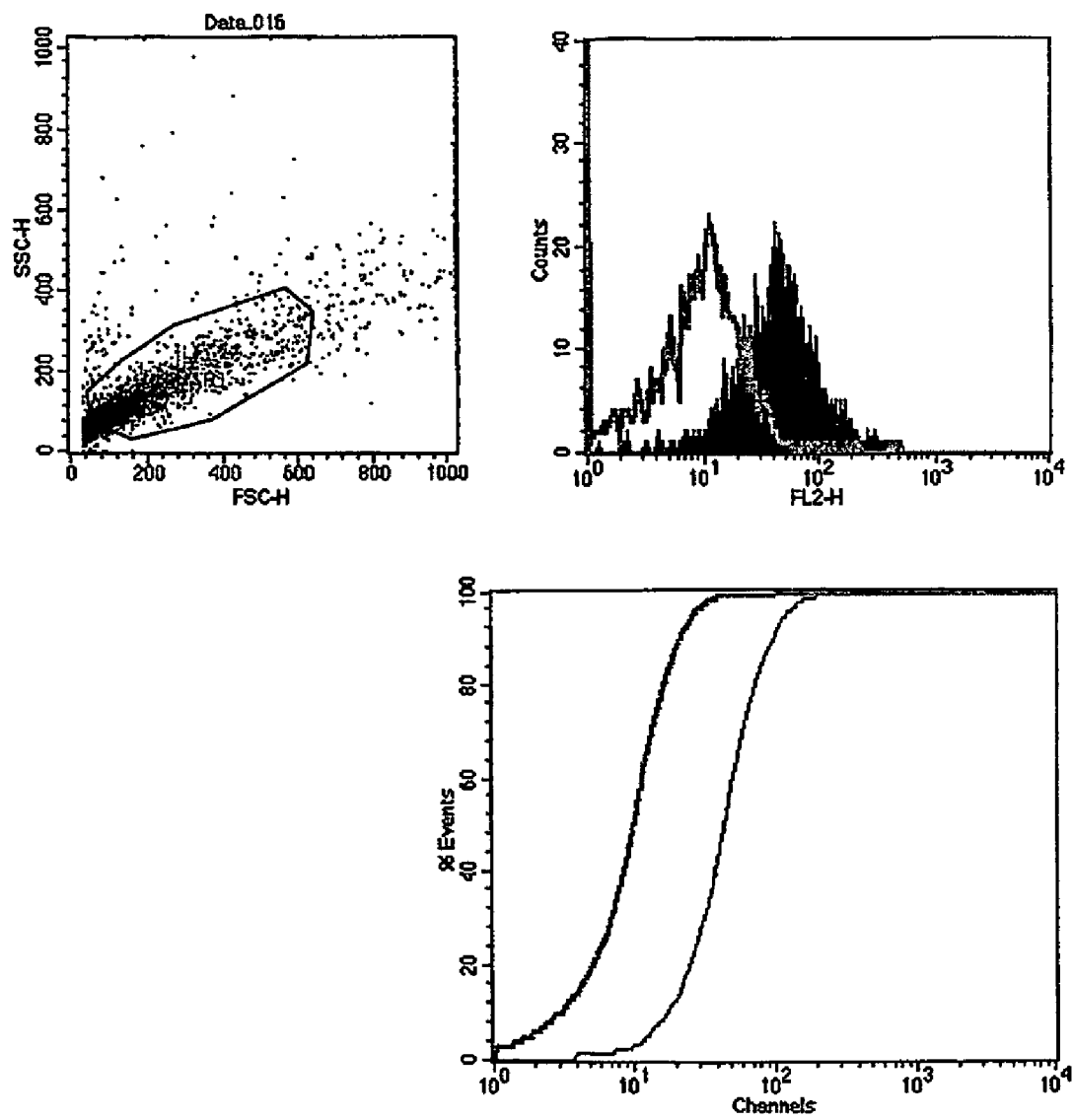
Figure 16A:
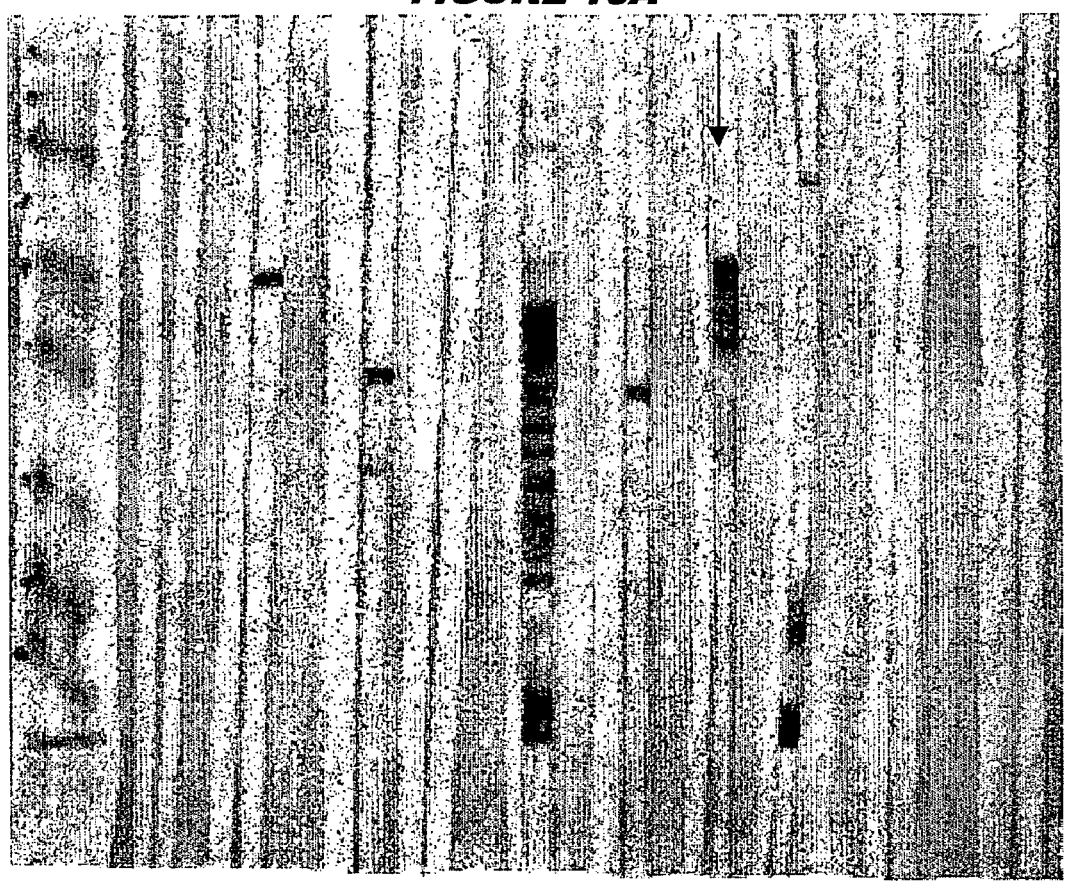
Figure 16B:
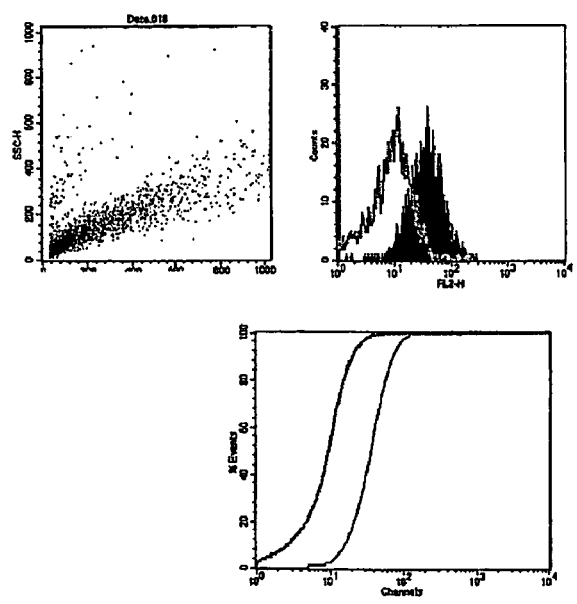
Figure 16C:
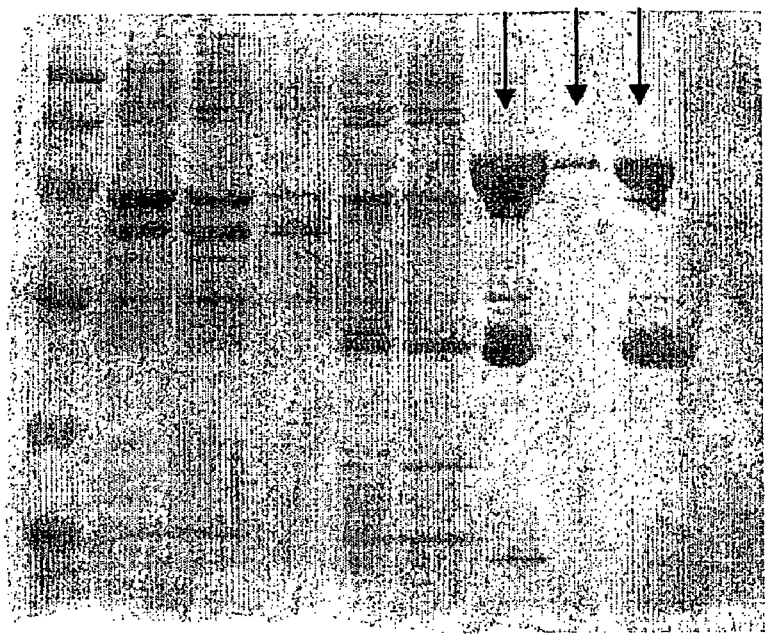

CT444 (SEQ ID 127 and SEQ ID 128) was expressed in *E.coli*. The recombinant product was purified as a GST-fusion protein (FIG. 12B: lanes 2 and 3, chromatography fractions 1 and 2, expected molecular weight 87.3 kDa) and as a His-tagged fusion protein (FIG. 12C: lanes 3 and 4, chromatography fractions 2 and 3, expected molecular weight 9.0 kDa). The recombinant protein was used to immunise mice, whose sera were used in a Western blot (FIG. 12A: lanes 16 and 17) and for FACS analysis (FIG. 12D: GST-tagged: K-S value 14.98; FIG. 12E: His-tagged: K-S value 13.28).

These experiments show that CT444 is a surface-exposed and immunoaccessible protein, and that it is a useful immunogen. These properties are not evident from the sequence alone.

EXAMPLE 13

CT559 (SEQ ID 199 and SEQ ID 200) was expressed in *E.coli*. The recombinant product was purified as a His-tagged protein (FIG. 13C: lanes 2, 3 and 4, chromatography fractions 1, 2 and 3. expected molecular weight 34.9 kDa). The recombinant protein was used to immunise mice, whose sera were used in a Western blot (FIG. 13A: lanes 6 and 7) and for FACS analysis (FIG. 13B: K-S value 23.21).

These experiments show that CT559 is a surface-exposed and immunoaccessible protein, and that it is a useful immunogen. These properties are not evident from the sequence alone.

EXAMPLE 14

CT681 (SEQ ID 155 and SEQ ID 156) was expressed in *E.coli*. The recombinant product was purified as a His-tagged fusion protein (FIG. 14C: lanes 5 and 6, chromatography fractions 1 and 2, expected molecular weight 41.8 kDa). The recombinant protein was used to immunise mice, whose sera were used in a Western blot (FIG. 14A: lanes 10 and 11) and for FACS analysis (FIG. 14B: K-S value 34.66).

These experiments show that CT681 is a surface-exposed and immunoaccessible protein, and that it is a useful immunogen. These properties are not evident from the sequence alone.

EXAMPLE 15

CT713 (SEQ ID 201 and SEQ ID 202) was expressed in *E.coli*. The recombinant product was purified as a His-tagged fusion protein (FIG. 15B: lanes 4, 5 and 6; chromatography fractions 1, 2 and 3, expected molecular weight 35.4 kDa). The recombinant protein was used to immunise mice, whose sera were used in a Western blot (FIG. 15A: lanes 12 and 13) and for FACS analysis (FIG. 15C: K-S value 25.82).

These experiments show that CT713 is a surface-exposed and immunoaccessible protein, and that it is a useful immunogen. These properties are not evident from the sequence alone.

EXAMPLE 16

CT823 (SEQ ED 229 and SEQ ID 230) was expressed in *E.coli*. The recombinant product was purified as a His-tagged fusion protein (FIG. 16C: lanes 7, 8 and 9, chromatography fractions 1, 2 and 3, expected molecular weight 53.9 kDa). The recombinant protein was used to immunise mice, whose sera were used in a Western blot (FIG. 16A: lanes 14 and 15) and for FACS analysis (FIG. 16B: K-S value 26.62).

These experiments show that CT823 is a surface-exposed and immunoaccessible protein, and that it is a useful immunogen. These properties are not evident from the sequence alone.

EXAMPLE 17

Figure 17:
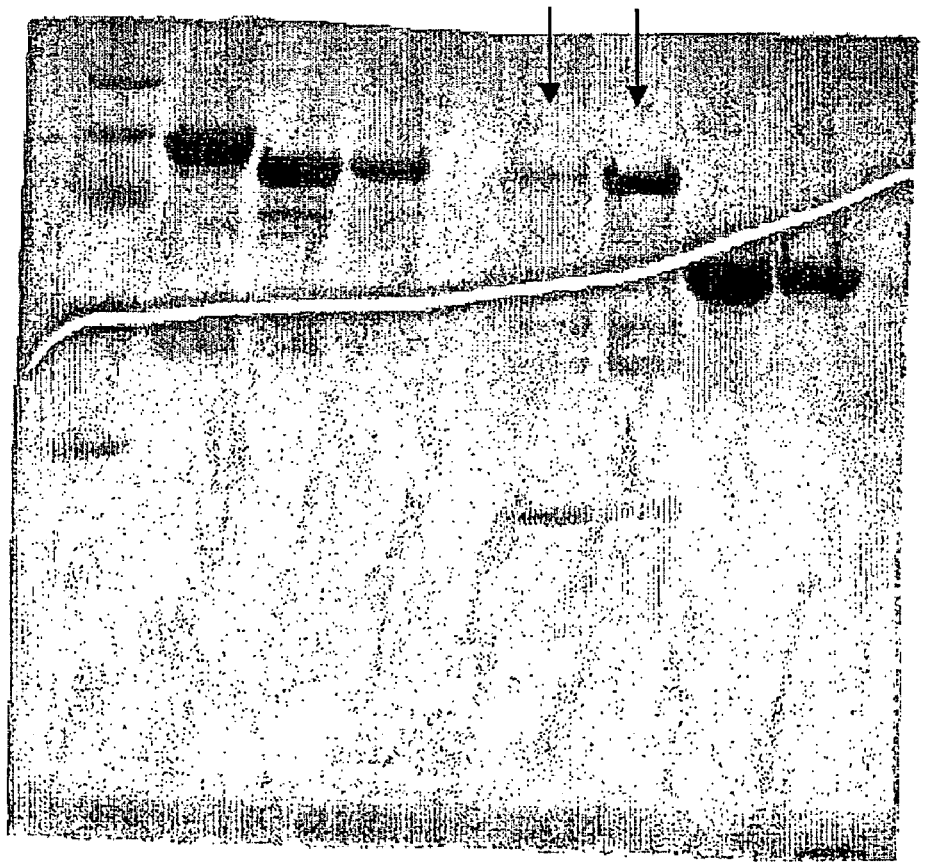

CT114 (SEQ ID 243 and SEQ ID 244) was expressed in *E.coli*. The recombinant product was purified as a His-tagged fusion protein (FIG. 17; lanes 6 and 7, chromatography fractions 1 and 2, expected molecular weight 48.5 kDa).

EXAMPLE 18

Figure 18A:
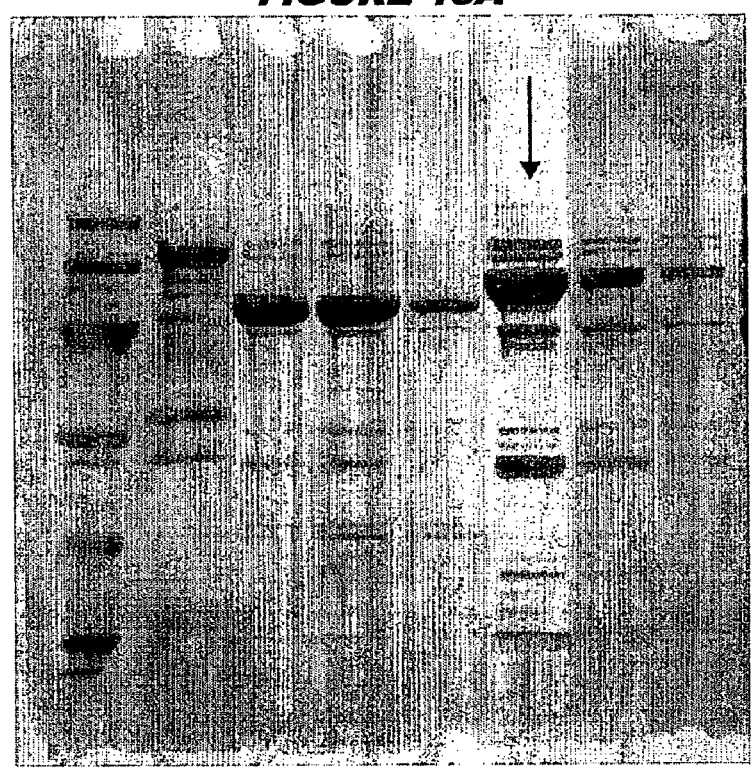
Figure 18B:
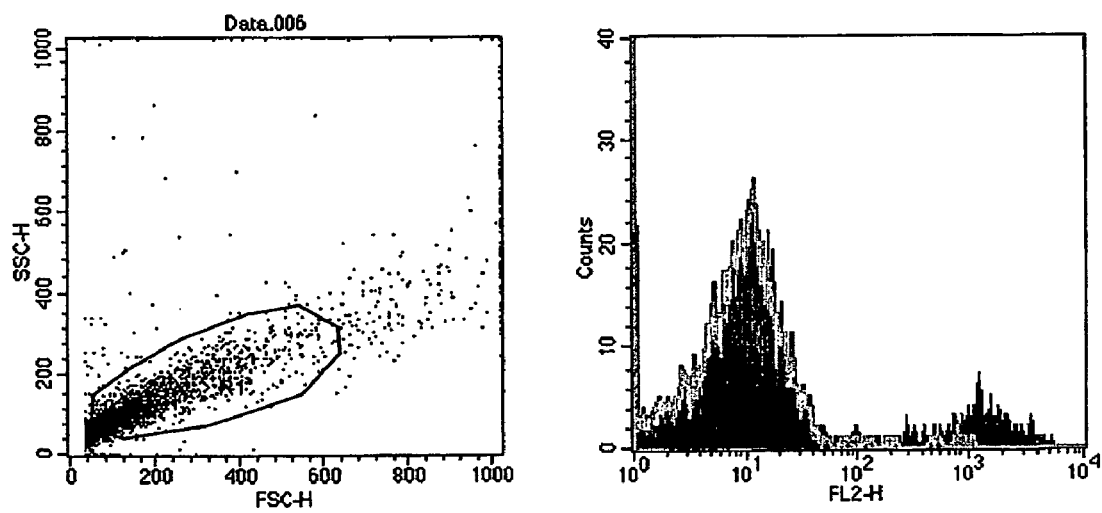

CT198 (SEQ ID 43 and SEQ ID 44) was expressed in *E.coli*. The recombinant product was purified as a His-tagged fusion protein (FIG. 18A; lane 6, chromatography fraction 1, expected molecular weight 56.3 kDa). The His-tagged recombinant protein was used to immunise mice, whose sera were used for FACS analysis (FIG. 18B).

These experiments show that CT198 is present in only part of an EB heterogeneous population (as chlamydial preparations usually are). Where it is present, it is a surface-exposed and immunoaccessible protein. These properties are not evident from the sequence alone.

EXAMPLE 19

Figure 19:
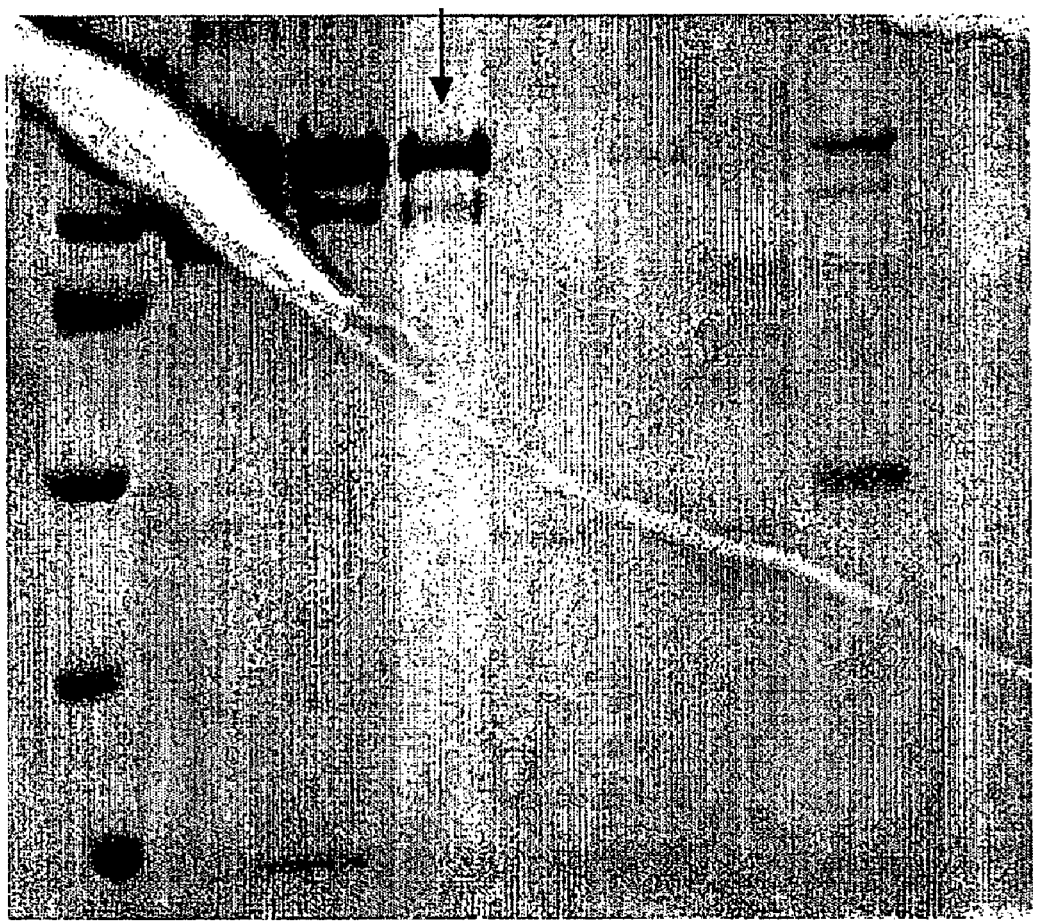

CT241 (SEQ ID 55 and SEQ ID 56) was expressed in *E.coli*. The recombinant product was purified as a His-tagged fusion protein (FIG. 19: lane 4, chromatography fraction 3, expected molecular weight 85.3 kDa).

EXAMPLE 20

Figure 20A:
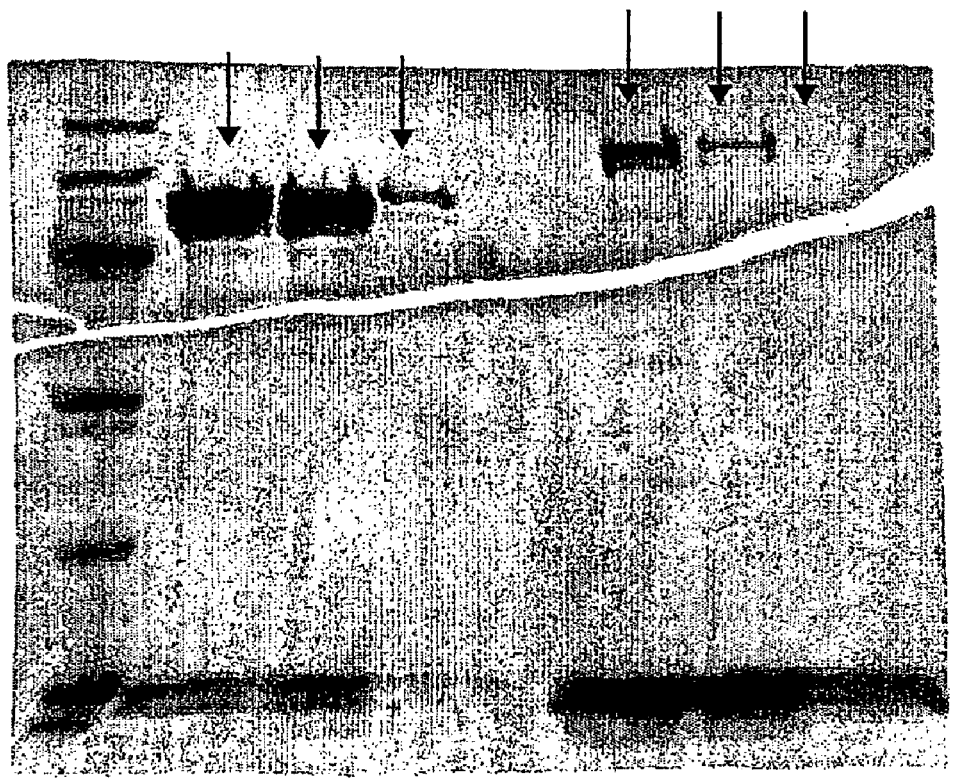
Figure 20B:
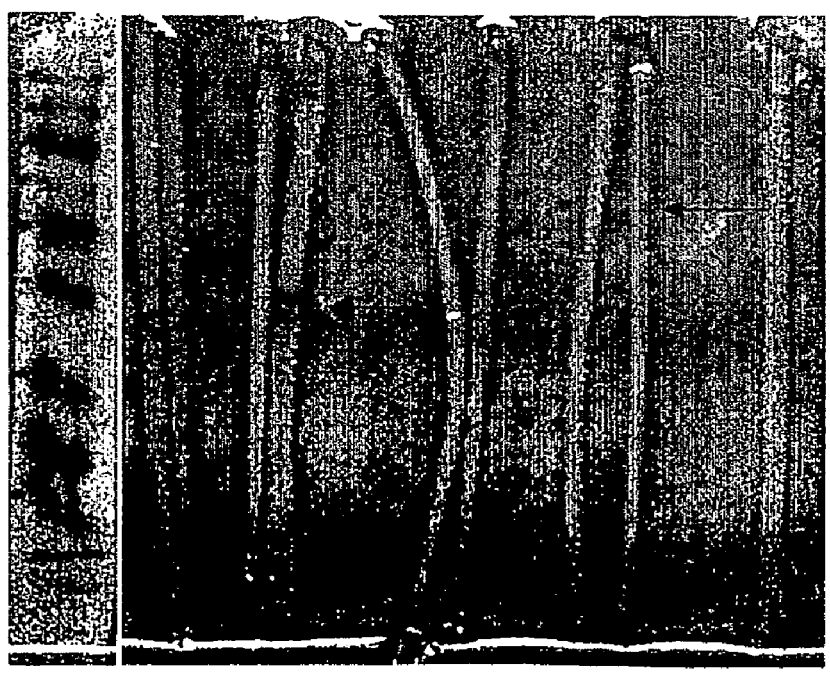

CT350 (SEQ ID 27 and SEQ ID 28) was expressed in *E.coli*. The recombinant product was purified both as a His-tagged fusion protein (FIG. 20A: lanes 2, 3 and 4, chromatography fractions 1, 2 and 3, expected molecular weight 61.3 kDa) and as a GST-tagged fusion protein. (FIG. 20A: lanes 7, 8 and 9, chromatography fractions 1, 2 and 3, expected molecular weight 87.3 kDa). The recombinant proteins were used to immunise mice, whose sera were used in a Western blot (FIG. 20B: His-tagged, lanes 4 and 5; GST-tagged, lanes 8 and 9).

EXAMPLE 21

Figure 21:
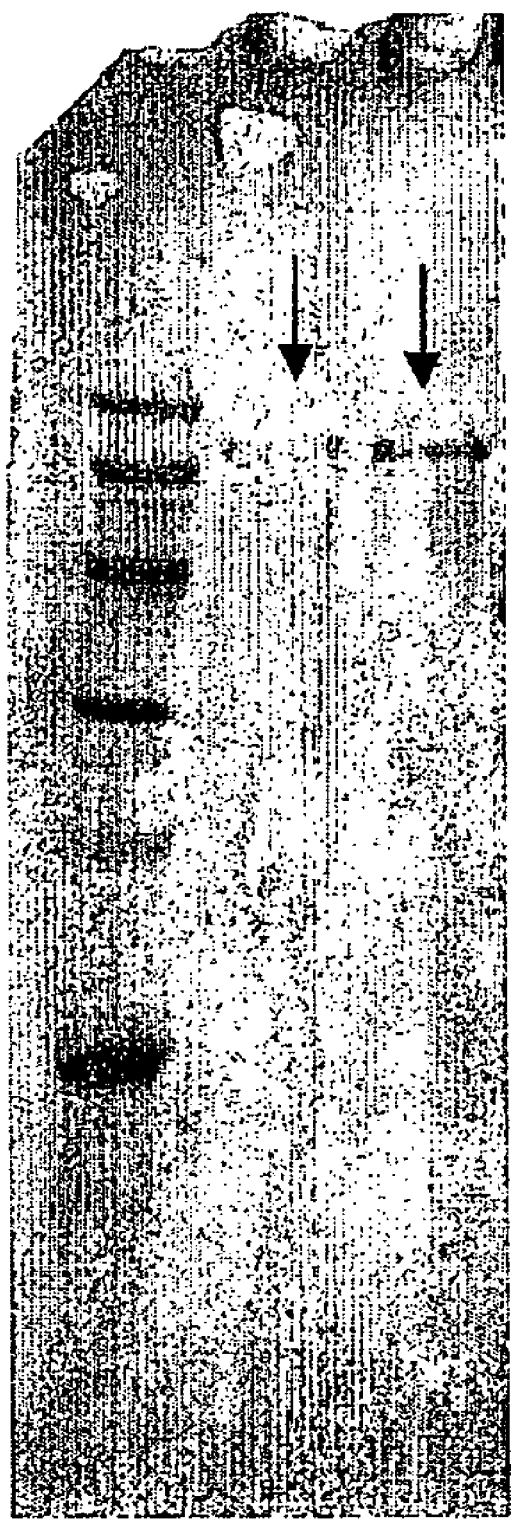

CT351 (SEQ ID 25 and SEQ ID 26) was expressed in *E.coli*. The recombinant product was purified as a His-tagged fusion protein (FIG. 21: lanes 2 and 3, chromatography fractions 1 and 2, expected molecular weight 76.1 kDa)

EXAMPLE 22

Figure 22:
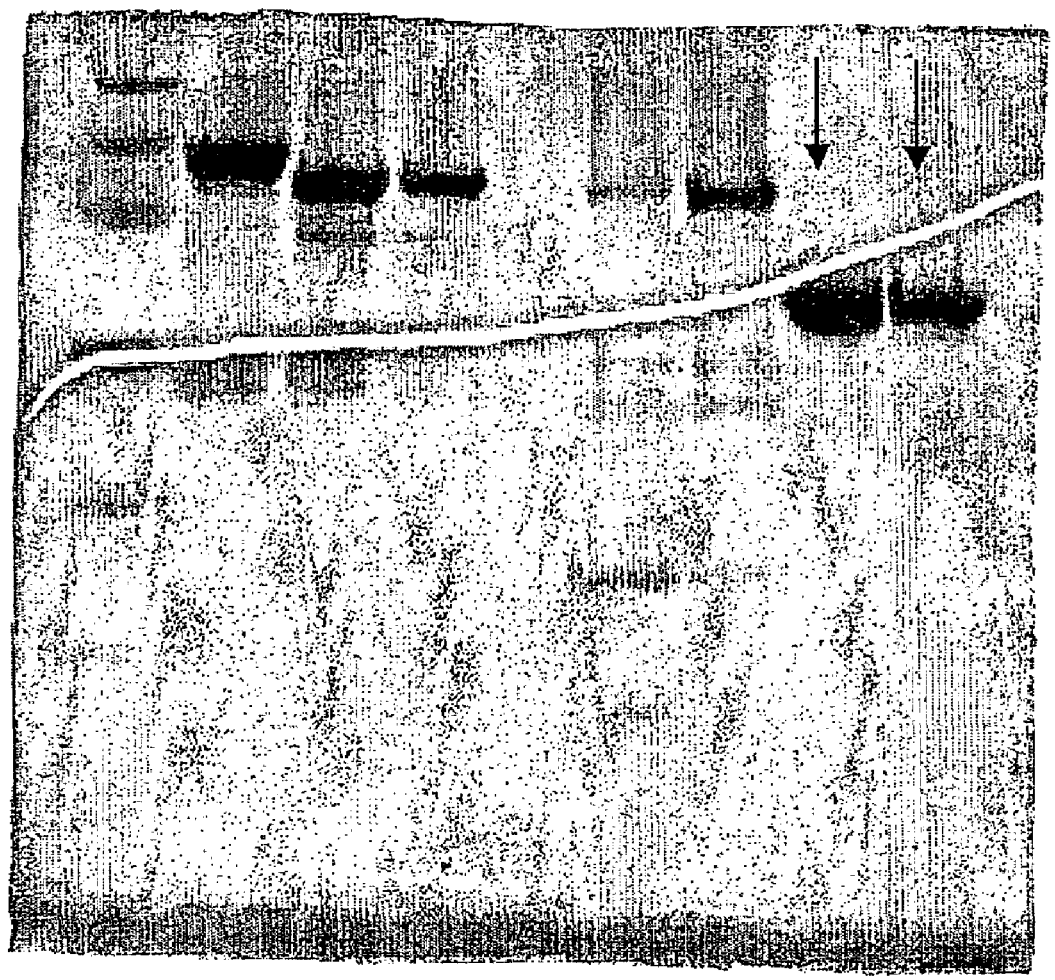

CT391 (SEQ ID 251 and SEQ ID 252) was expressed in *E.coli*. The recombinant product was purified as a His-tagged fusion protein (FIG. 22: lanes 8 and 9, chromatography fractions 1 and 2, expected molecular weight 32.6 kDa).

EXAMPLE 23

Figure 23A:
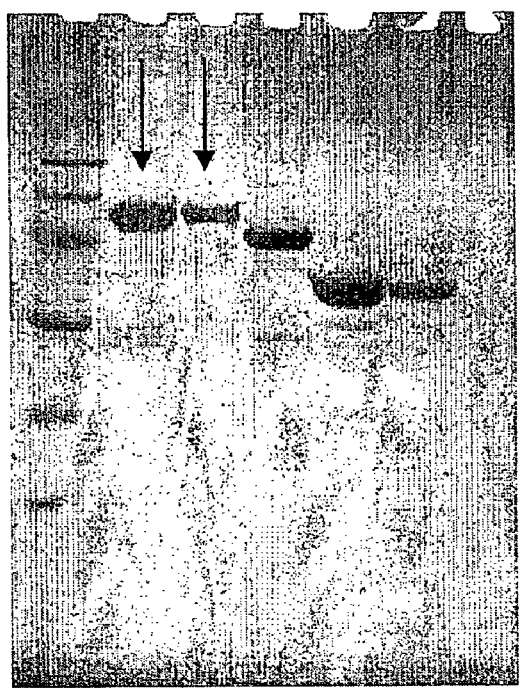
Figure 23B:
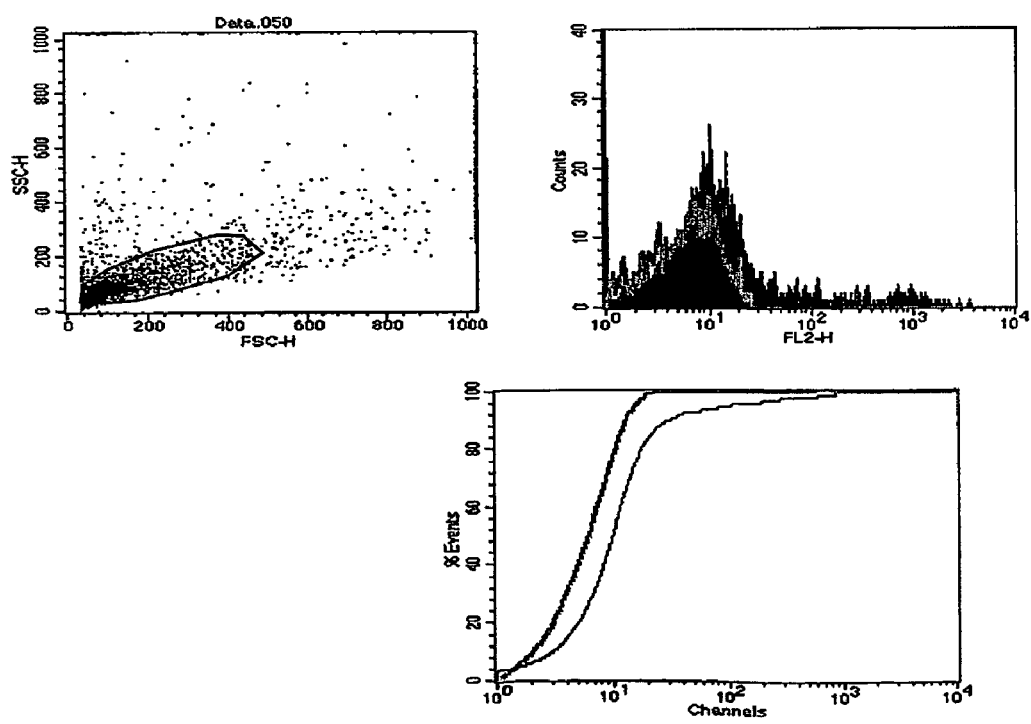
Figure 23C:
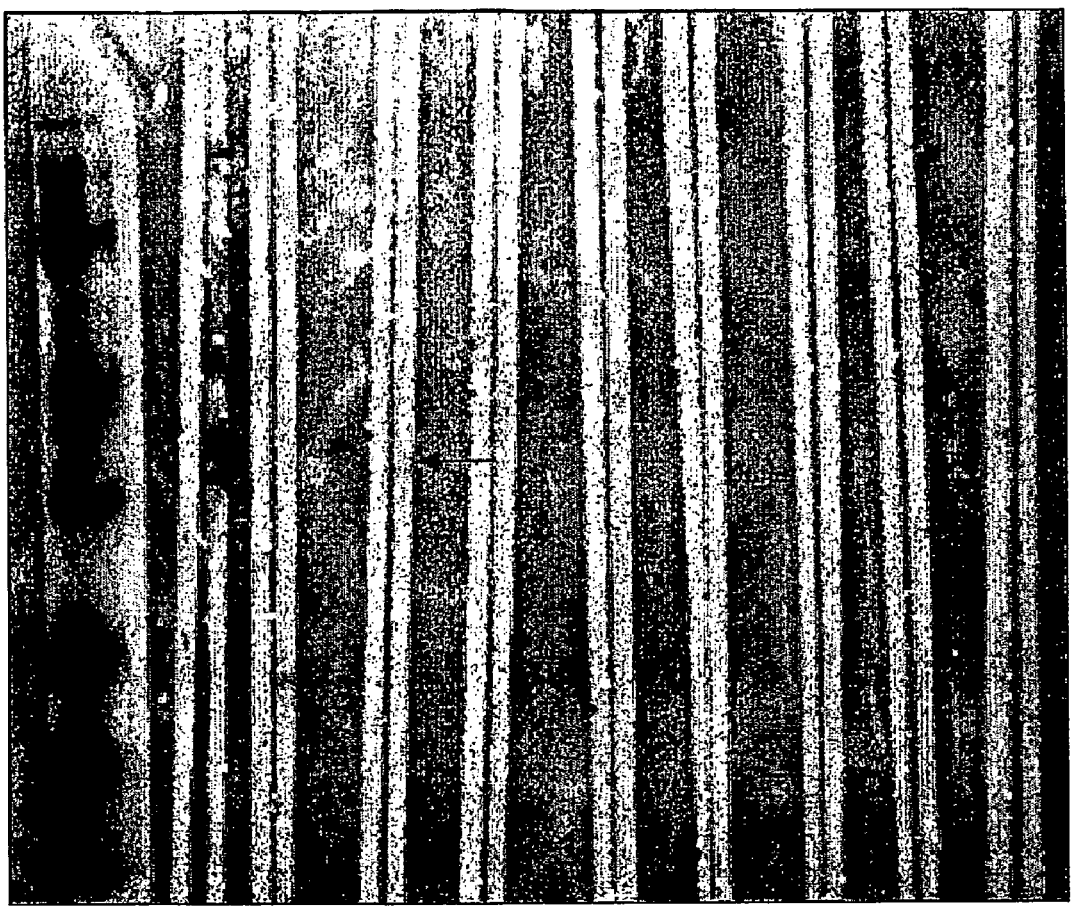

CT077 (SEQ ID 65 and SEQ ID 66) was expressed in *E.coli*. The recombinant product was purified as a GST-tagged fusion protein (FIG. 23: lanes 2 and 3, chromatography fractions 1 and 2, expected molecular weight 59.7 kDa) and as a His-tagged fusion protein. The recombinant protein was used to immunise mice, whose sera were used in a Western blot (FIG. 23C: lanes 6 and 7) and for FACS analysis (FIG. 23B, His-tagged: K-S value 9.17).

These experiments show that CT077 is a surface-exposed and immunoaccessible protein, and that it is a useful immunogen. These properties are not evident from the sequence alone.

EXAMPLE 24

Figure 24A:
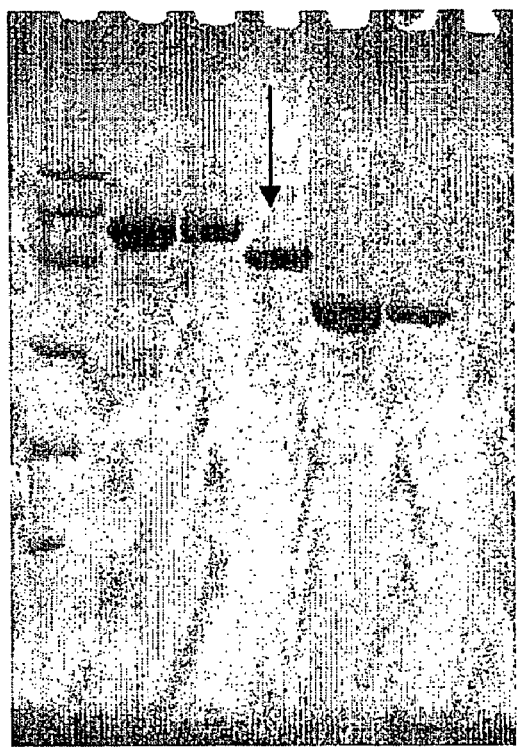
Figure 24B:
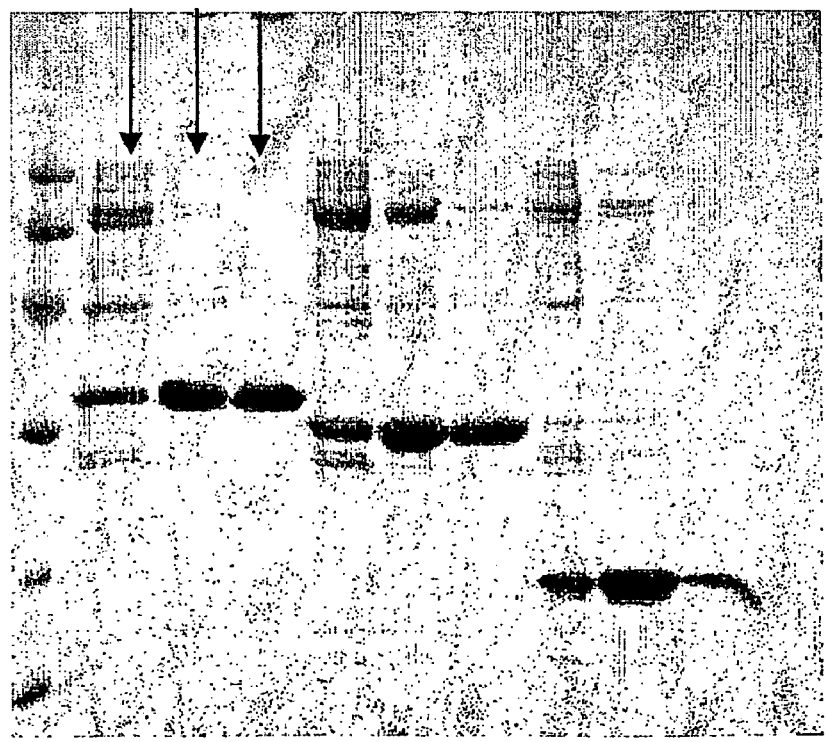
Figure 24C:
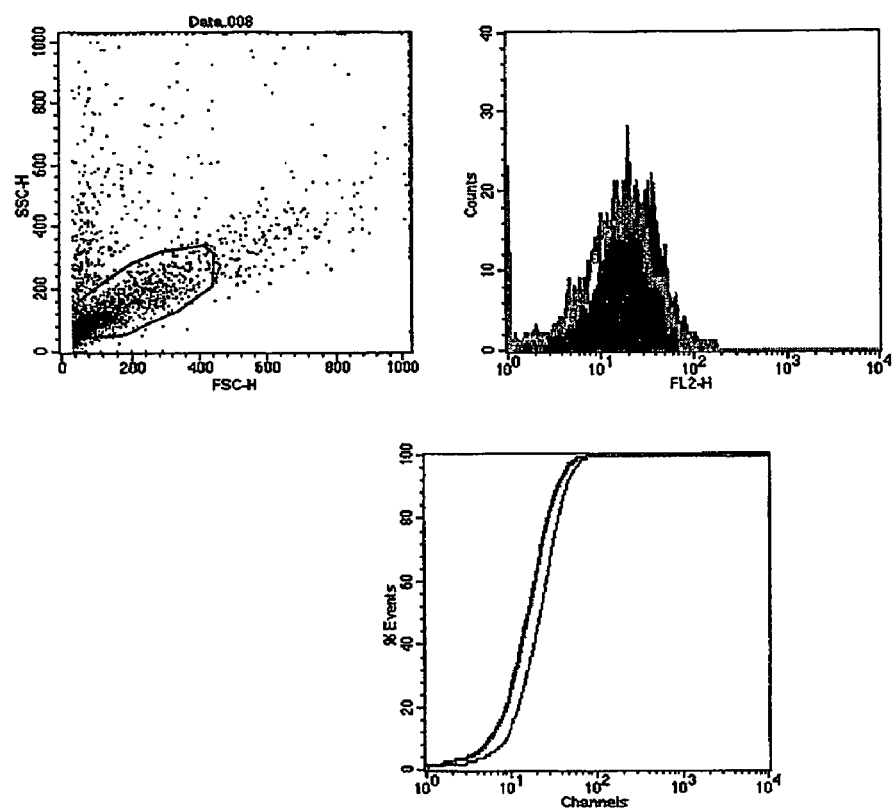
Figure 24D:
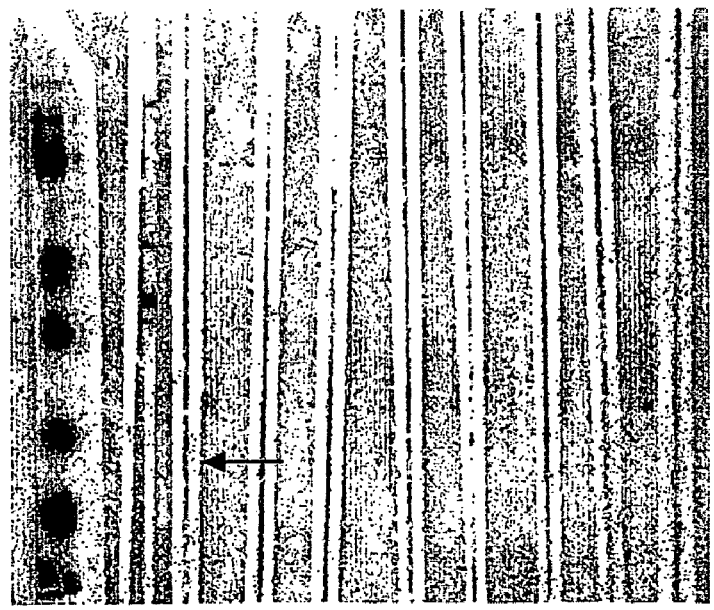

CT181 (SEQ ID 245 and SEQ ID 246) was expressed in *E.coli*. The recombinant product was purified both as a GST-tagged fusion protein (FIG. 24A: lane 4, chromatography fraction 1, expected molecular weight 50.1 kDa) and a His-tagged fusion protein (FIG. 24B: lanes 2, 3 and 4, chromatography fractions 1, 2 and 3, expected molecular weight 32.0 kDa). The GST-tagged recombinant protein was used to immunise mice, whose sera were used in a Western blot (FIG. 24D, lanes 4 and 5 (indicated by arrow)) and for FACS analysis (FIG. 24C, K-S value 7.62).

These experiments show that CT181 is a surface-exposed and immunoaccessible protein, and that it is a useful immunogen. These properties are not evident from the sequence alone.

EXAMPLE 25

Figure 25A:
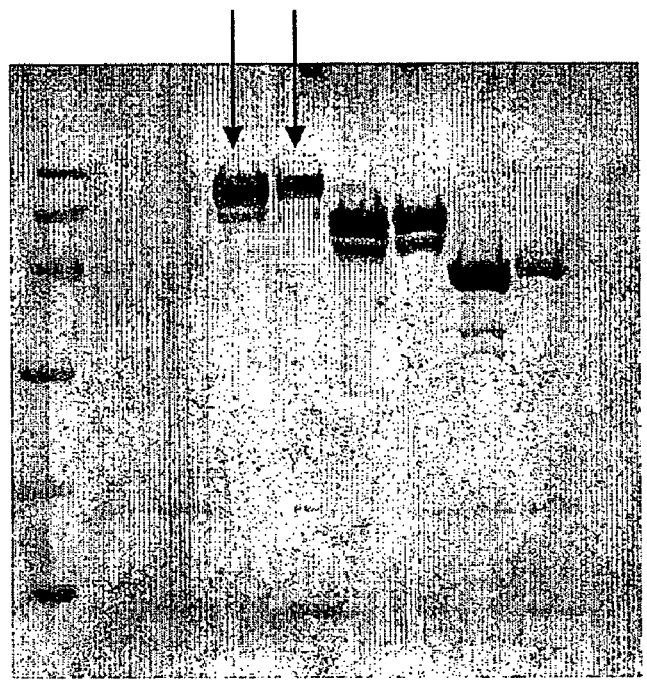
Figure 25B:
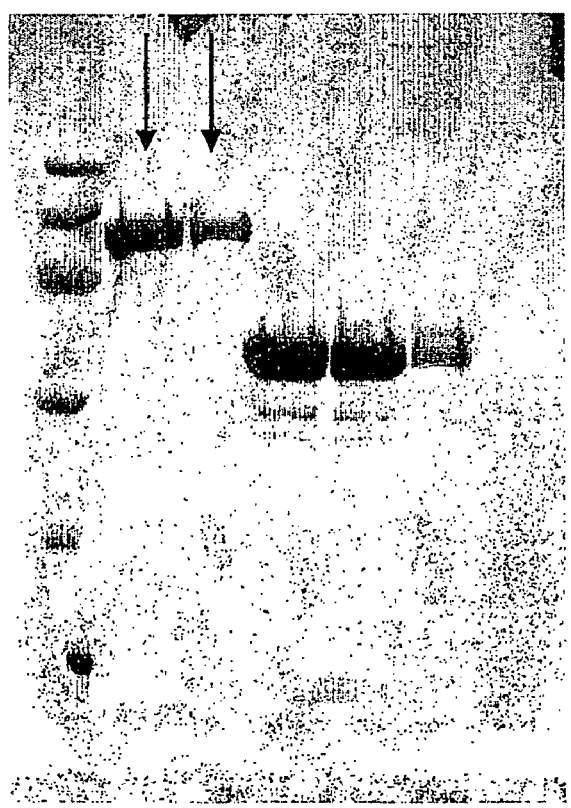
Figure 25C:
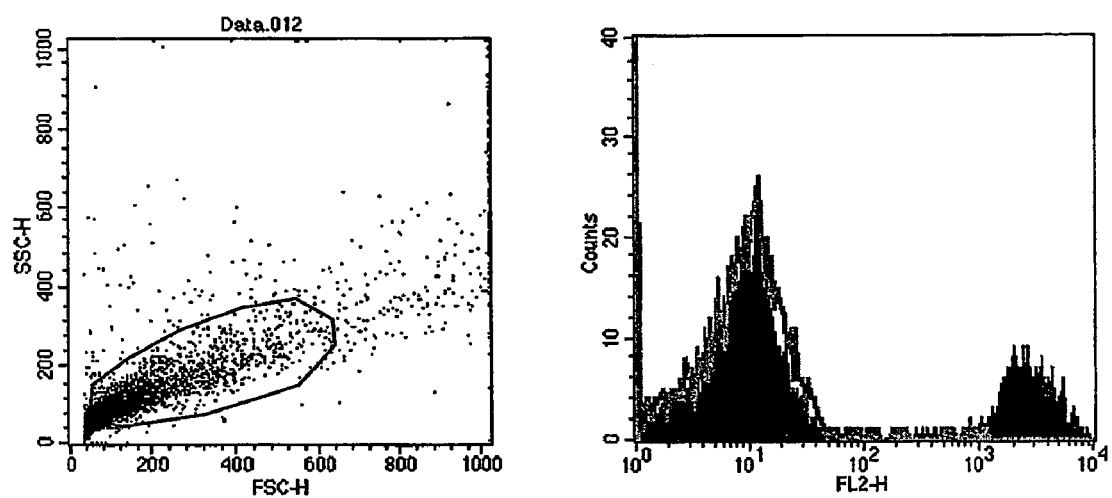

CT589 (SEQ ID 185 and SEQ ID 186) was expressed in *E.coli*. The recombinant product was purified both as a GST-tagged fusion protein (FIG. 25A: lanes 4 and 5, chromatography fractions 1 and 2, expected molecular weight 89.4 kDa) and as a His-tagged fusion protein (FIG. 25B: lanes 2 and 3, chromatography fractions 1 and 2, expected molecular weight 63.4 kDa). The His-tagged recombinant protein was used to immunise mice, whose sera were used for FACS analysis (FIG. 25C).

These experiments show that CT589 is present in only part of an EB heterogeneous population (as chlamydial preparations usually are). Where it is present, it is a surface-exposed and immunoaccessible protein. These properties are not evident from the sequence alone.

EXAMPLE 26

Figure 26A:
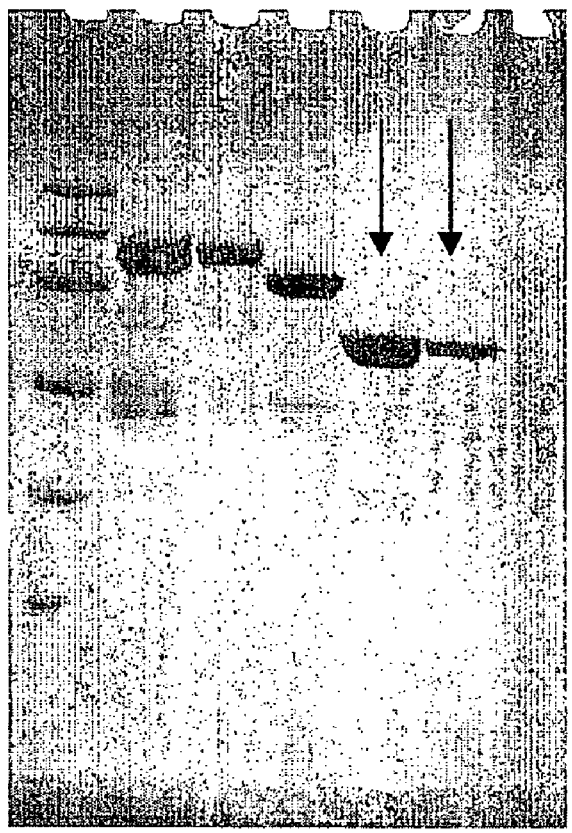
Figure 26B:
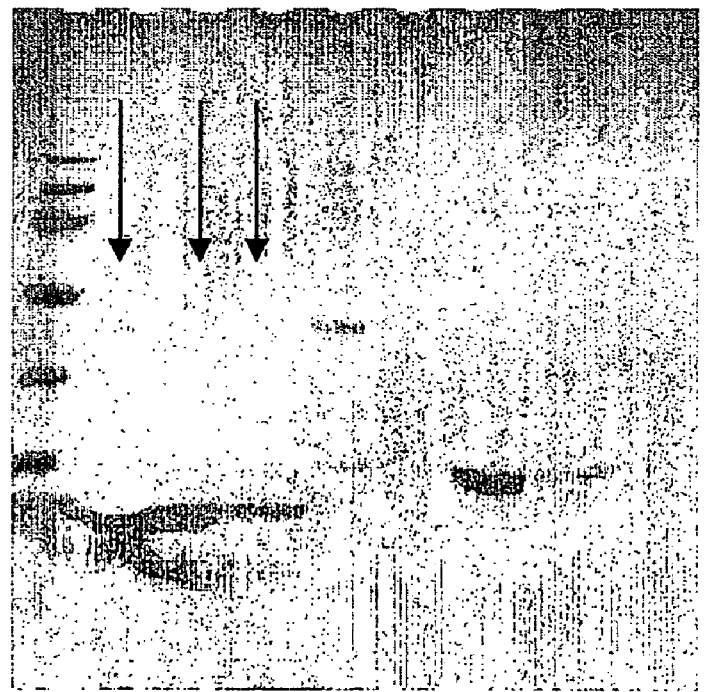

CT597 (SEQ ID 179 and SEQ ID 180) was expressed in *E.coli*. The recombinant product was purified both as a GST-tagged fusion protein (FIG. 26A: lanes 5 and 6, chromatography fractions 1 and 2, expected molecular weight 36.0 kDa) and as a His-tagged fusion protein (FIG. 26B: lanes 2, 3 and 4, chromatography fractions 1,2 and 3, expected molecular weight 10.3 kDa).

EXAMPLE 27

Figure 27A:
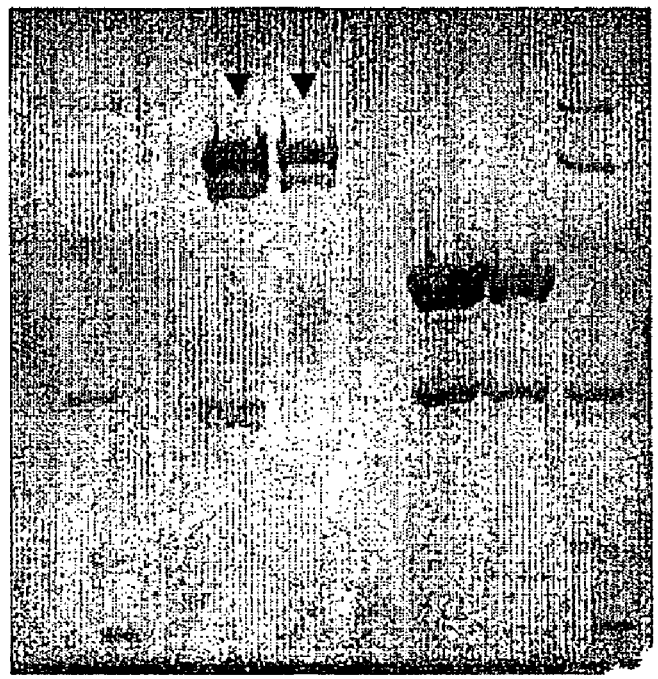
Figure 27B:
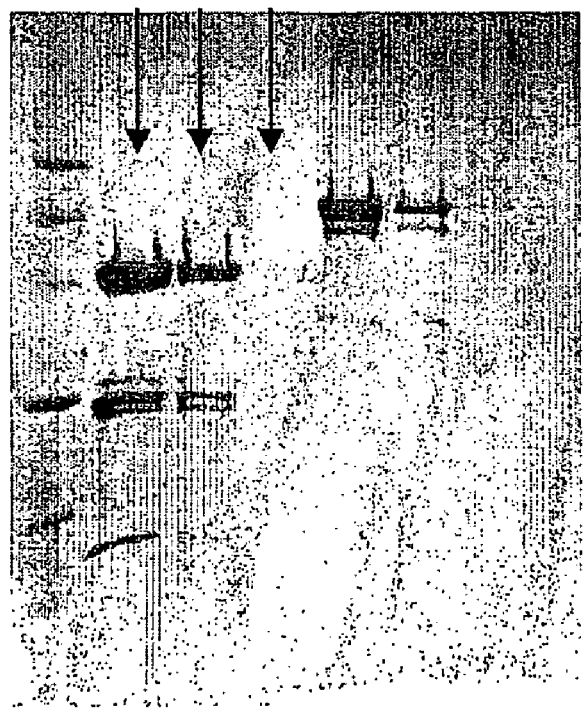
Figure 27C:
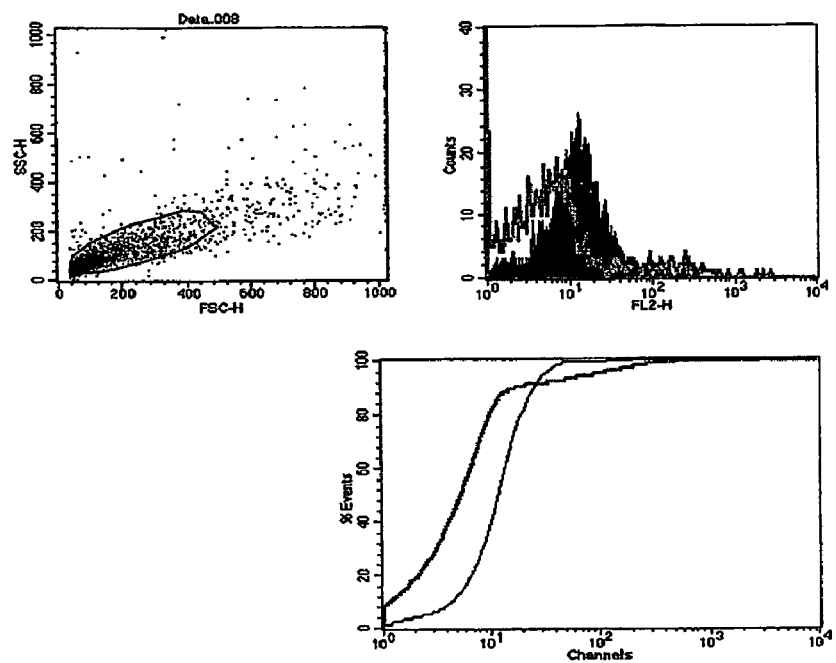
Figure 27D:
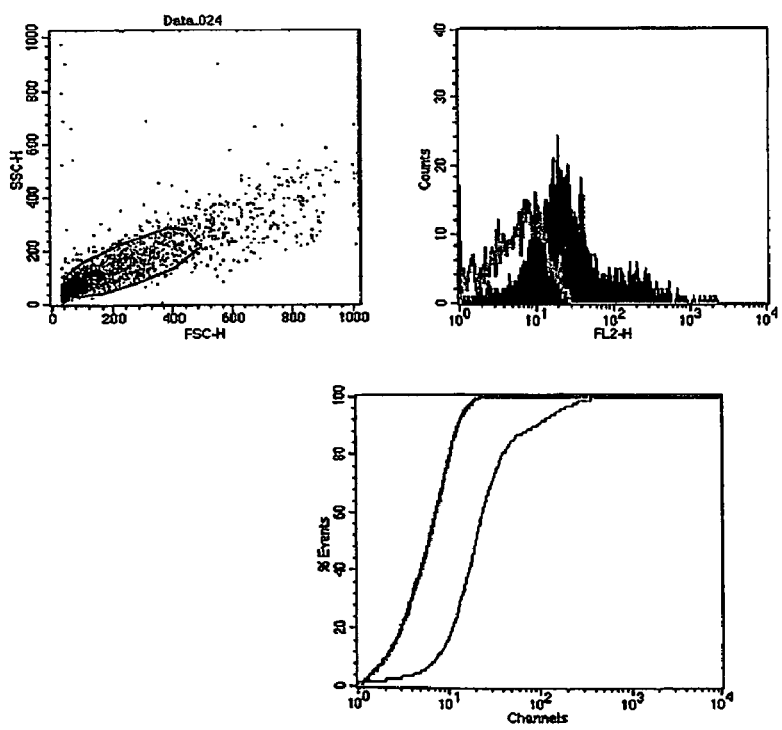
Figure 27E:
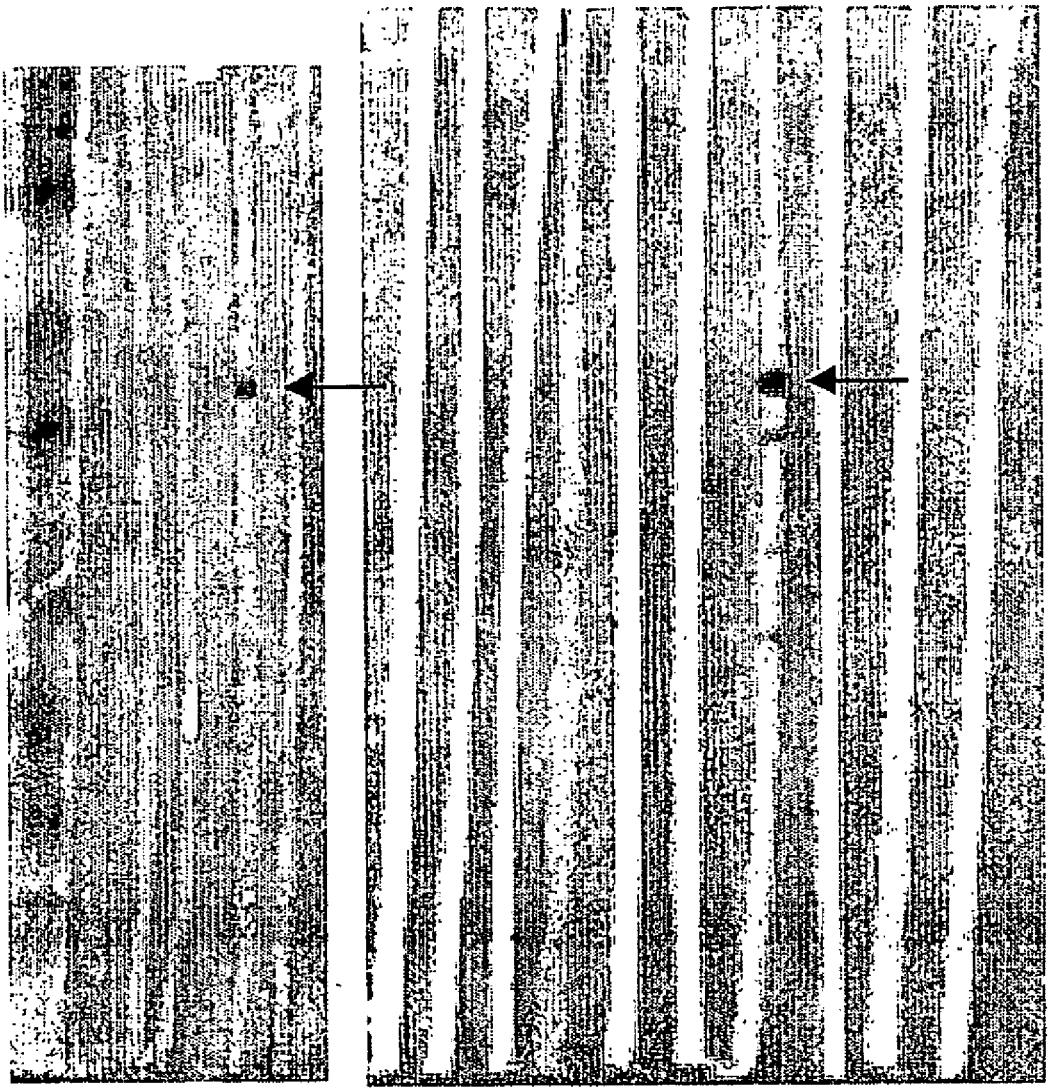

CT623 (SEQ ID 163 and SEQ ID 164) was expressed in *E.coli*. The recombinant product was purified both as a GST-tagged fusion protein (FIG. 27A: lanes 3 and 4, chromatography fractions 1 and 2, expected molecular weight 71.8 kDa) and as a His-tagged fusion protein (FIG. 27B: lanes 2, 3 and 4, chromatography fractions 1, 2 and 3, expected molecular weight 45.8 kDa). The recombinant protein was used to immunise mice, whose sera were used in a Western Blot (FIG. 27E: GST-tagged, lane 4 (indicated by arrow); His-tagged, lane 13 (indicated by arrow)) and for FACS analysis (FIG. 27C: GST-tagged: K-S value 15.89; FIG. 27D: His-tagged: K-S value 20.27).

These experiments show that CT623 is a surface-exposed and immunoaccessible protein, and that it is a useful immunogen. These properties are not evident from the sequence alone.

EXAMPLE 28

Figure 28A:
Figure 28B:
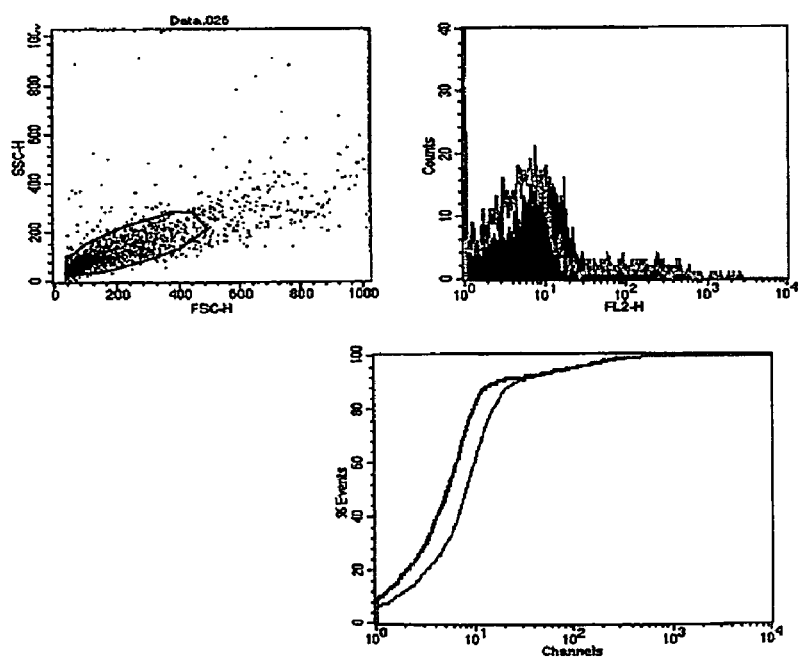

CT700 (SEQ ID 261 and SEQ ID 262) was expressed in *E.coli*. The recombinant product was purified as a GST-tagged fusion protein (FIG. 28A: lanes 5, 6 and 7, chromatography fractions 1, 2 and 3, expected molecular weight 73.7 kDa). The recombinant protein was used to immunise mice, whose sera were used for FACS analysis (FIG. 28B: K-S value 8.72).

These experiments show that CT700 is a surface-exposed and immunoaccessible protein, and that it is a useful immunogen. These properties are not evident from the sequence alone.

EXAMPLE 29

Figure 29A:
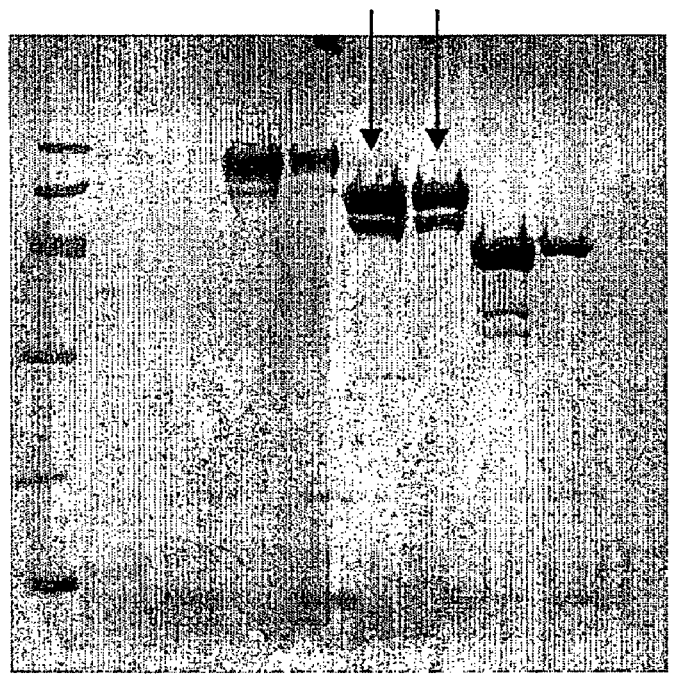
Figure 29B:
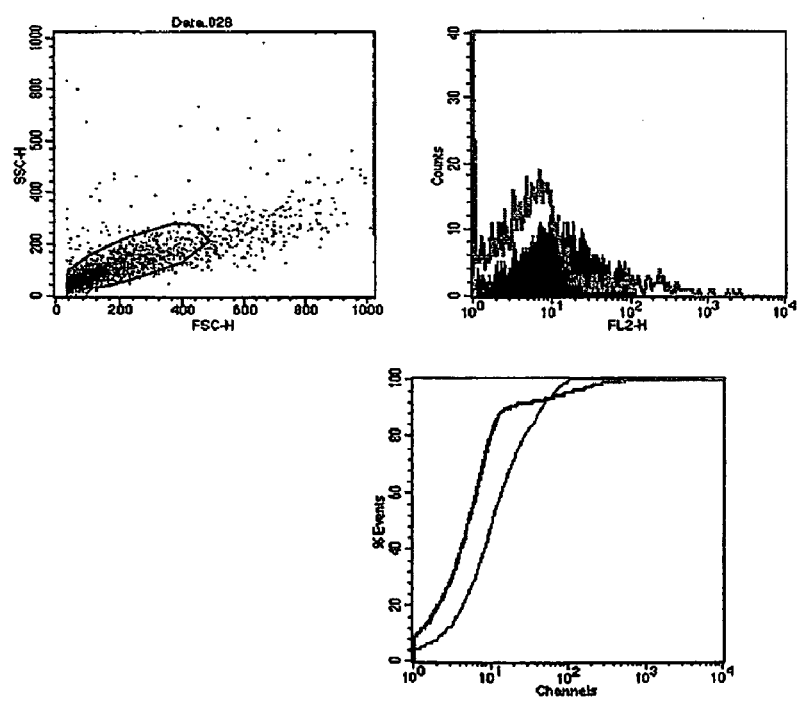

CT761 (SEQ ID 217 and SEQ ID 218) was expressed in *E.coli*. The recombinant product was purified as a GST-tagged fusion protein (FIG. 29A: lanes 6 and 7, chromatography fractions 1 and 2, expected molecular weight 63.9 kDa). The recombinant protein was used to immunise mice, whose sera were used for FACS analysis (FIG. 29B, K-S value 11.45).

These experiments show that CT761 is a surface-exposed and immunoaccessible protein, and that it is a useful immunogen. These properties are not evident from the sequence alone.

EXAMPLE 30

Figure 30:
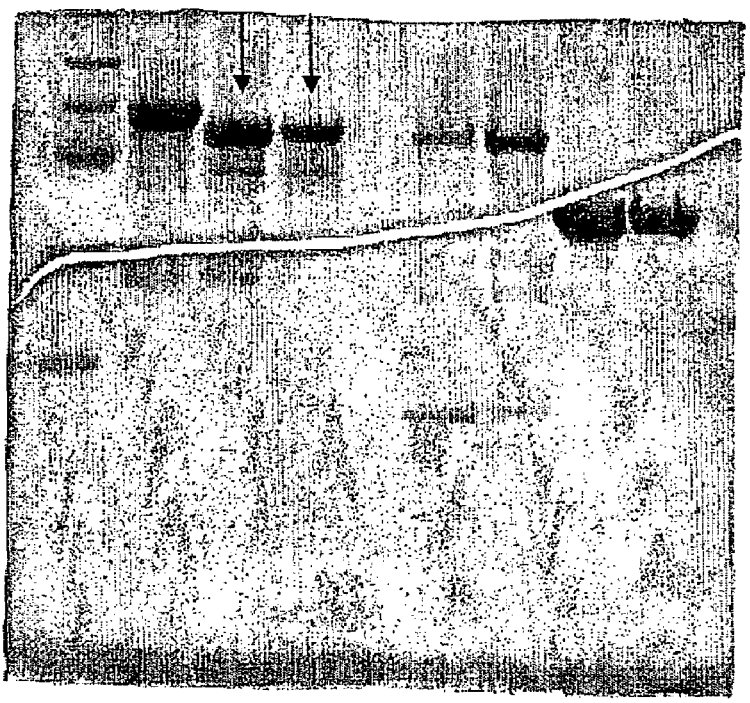

CT415 (SEQ ID 117 and SEQ ID 118) was expressed in *E.coli*. The recombinant product was purified as a GST-tagged fusion protein (FIG. 30: lanes 3 and 4, chromatography fractions 1 and 2, expected molecular weight 55.4 kDa).

EXAMPLE 31

Figure 31:

CT454 (SEQ ID 253 and SEQ D) 254) was expressed in *E.coli*. The recombinant product was purified as a His-tagged fusion protein (FIG. 31: lanes 2 and 3, chromatography fractions 1 and 2, expected molecular weight 56.2 kDa).

EXAMPLE 32

Figure 32:
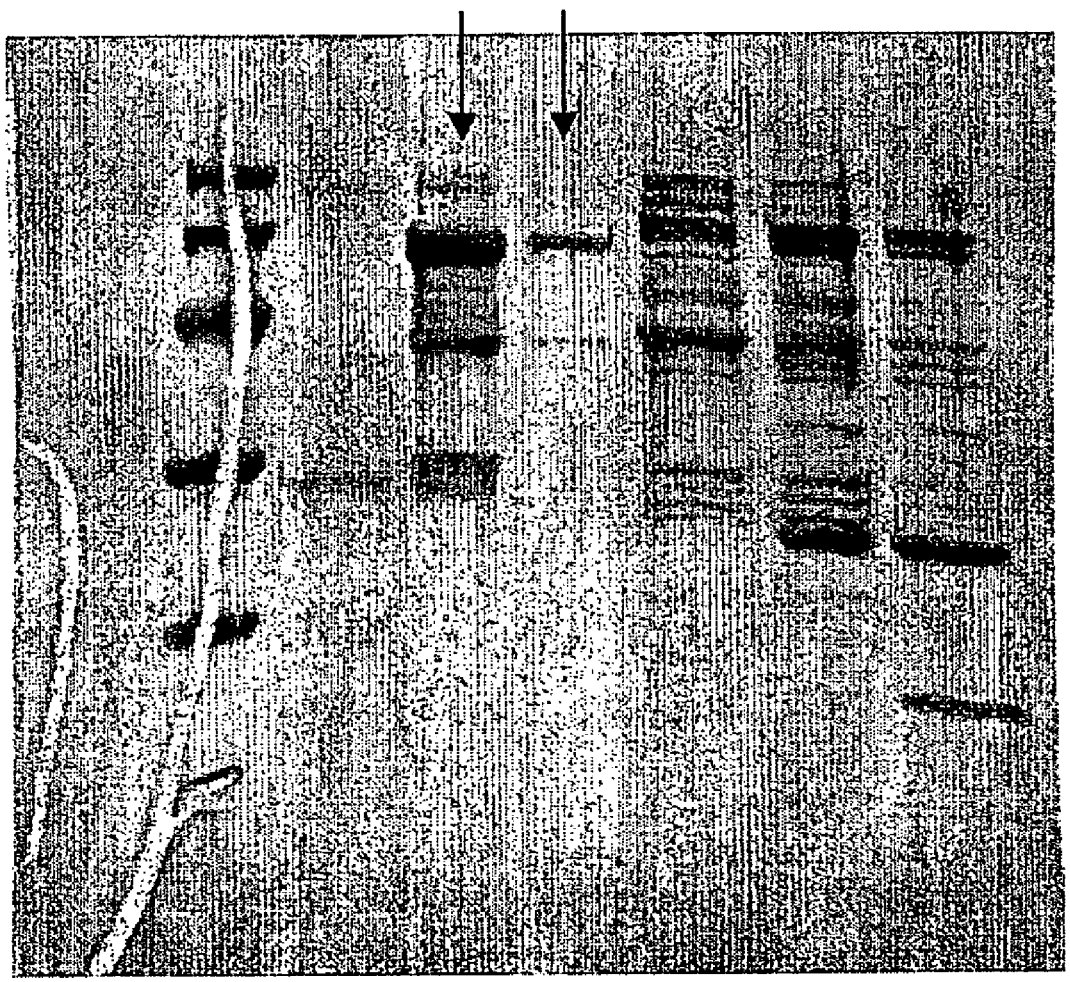

CT467 (SEQ ID 129 and SEQ ID 130) was expressed in *E.coli*. The recombinant product was purified as a GST-tagged fusion protein (FIG. 32: lanes 3 and 4, chromatography fractions 1 and 2, expected molecular weight 65.6 kDa).

EXAMPLE 33

Figure 33A:
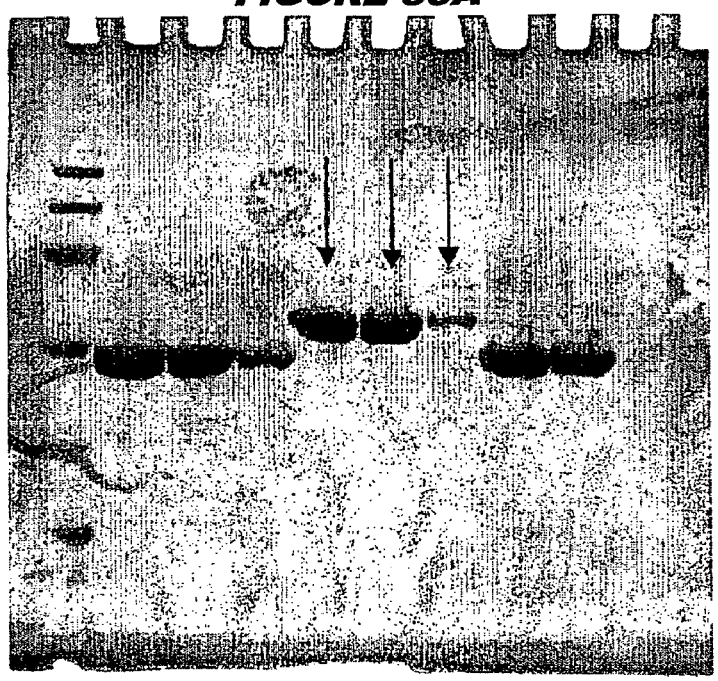
Figure 33B:

CT551 (SEQ ID 257 and SEQ ID 258) was expressed in *E.coli*. The recombinant product was purified both as a His-tagged fusion protein (FIG. 33A: lanes 5, 6 and 7, chromatography fractions 1, 2 and 3, expected molecular weight 34.1 kDa) and as a GST-tagged fusion protein (FIG. 33B: lanes 4 and 5, chromatography fractions 1 and 2, expected molecular weight 60.1 kDa).

EXAMPLE 34

Figure 34A:
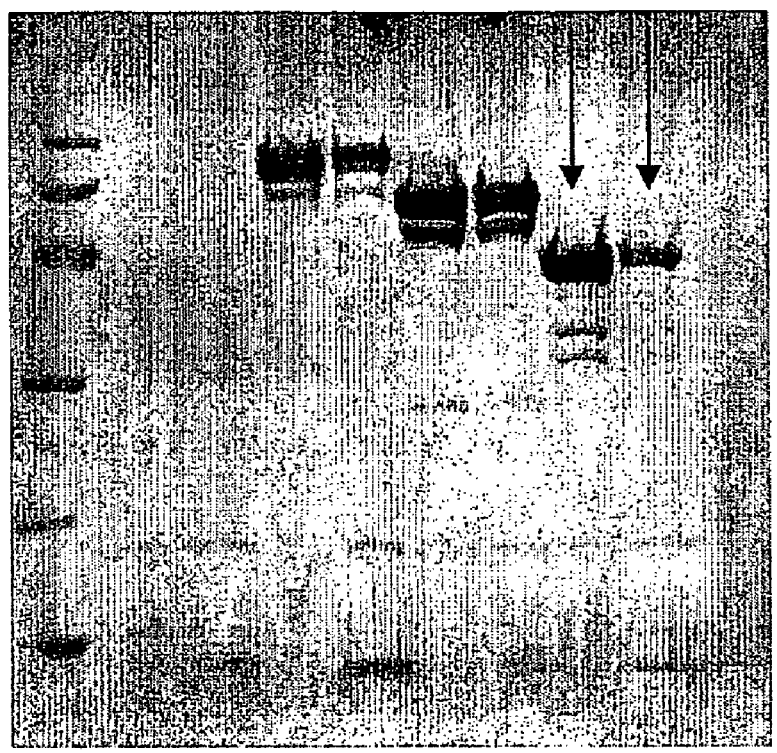
Figure 34B:
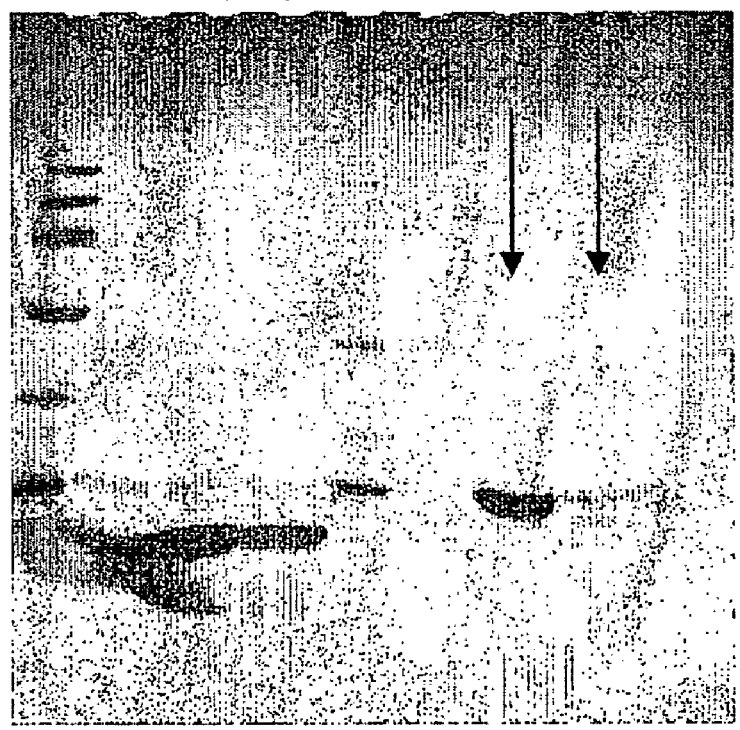

CT567 (SEQ ID 195 and SEQ ID 196) was expressed in *E.coli*. The recombinant product was purified both as a GST-tagged fusion protein (FIG. 34A: lanes 8 and 9, chromatography fractions 1 and 2, expected molecular weight 44.0 kDa) and as a His-tagged fusion protein (FIG. 34B: lanes 7 and 8, chromatography fractions 1 and 2, expected molecular weight 18.3 kDa).

EXAMPLE 35

Figure 35A:
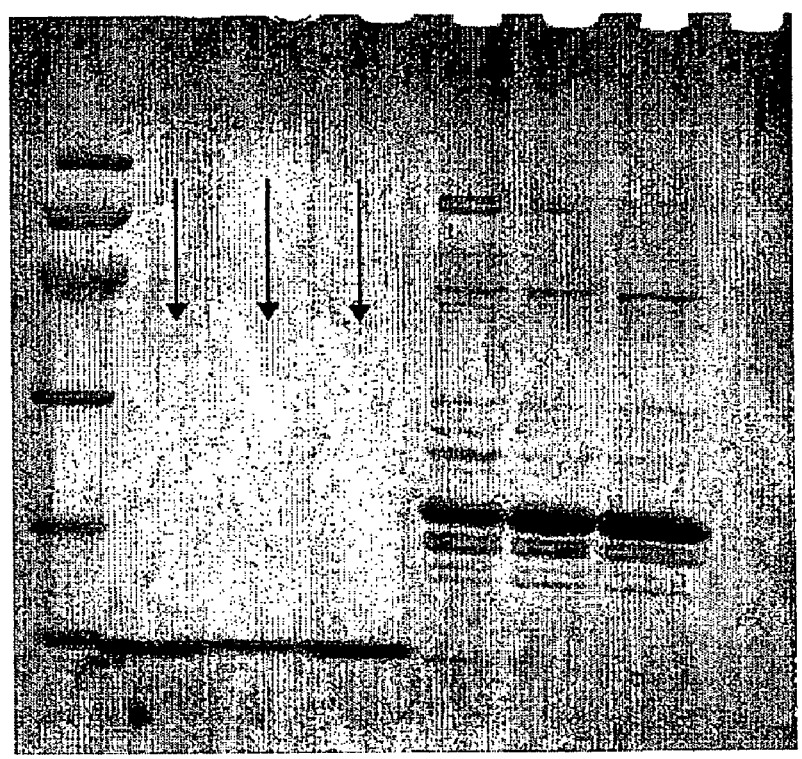
Figure 35B:
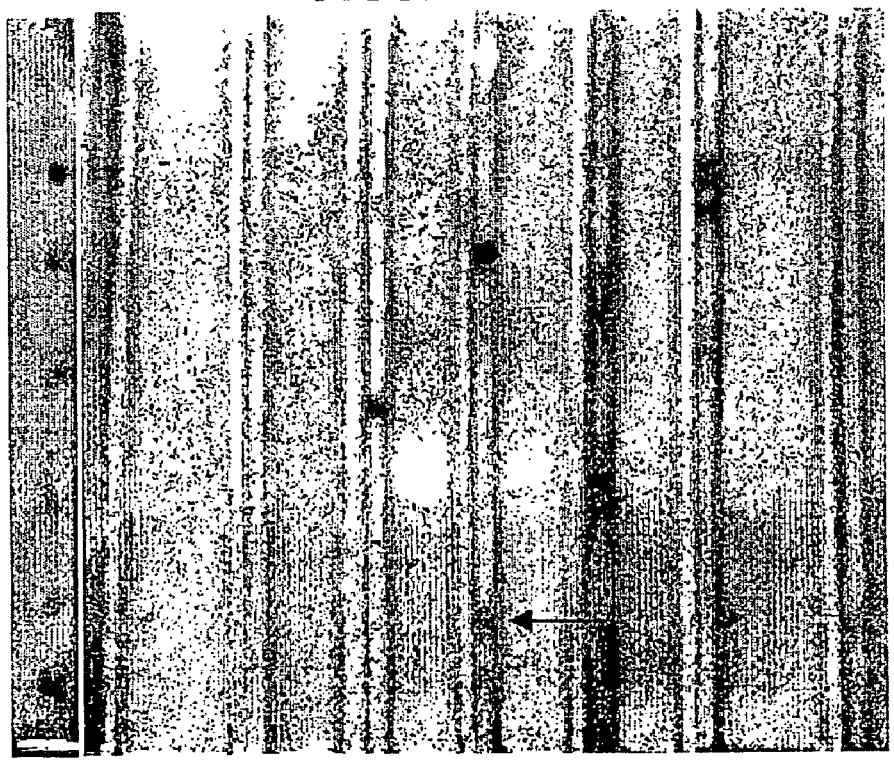

CT569 (SEQ ID 193 and SEQ ID 194) was expressed in *E.coli*. The recombinant product was purified as a His-tagged fusion protein (FIG. 35A: lanes 2, 3 and 4, chromatography fractions 1, 2 and 3, expected molecular weight 11.2 kDa). The recombinant protein was used to immunise mice, whose sera were used in a Western blot (FIG. 35B: lanes 8 and 9, indicated with an arrow).

EXAMPLE 36

Figure 36:

CT647 (SEQ ID 169 and SEQ ID 170) was expressed in *E.coli*. The recombinant product was purified as a GST-tagged fusion protein (FIG. 36: lanes 6 and 7, chromatography fractions 1 and 2, expected molecular weight 45.7 kDa).

EXAMPLE 37

Figure 37A:
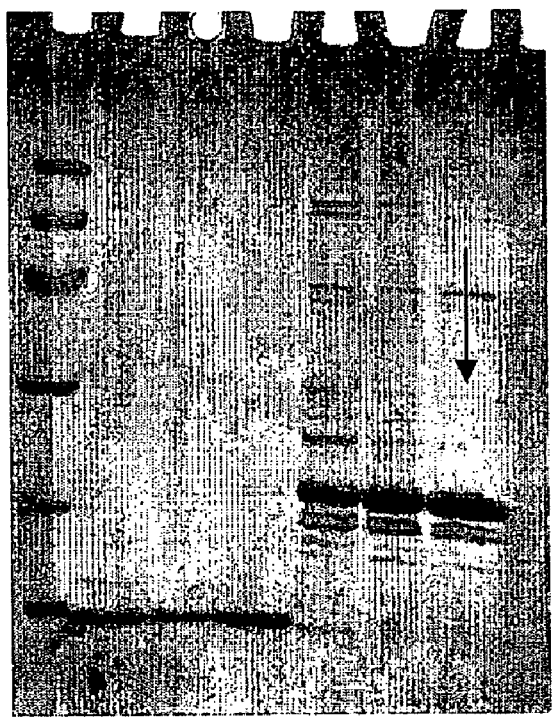
Figure 37B:
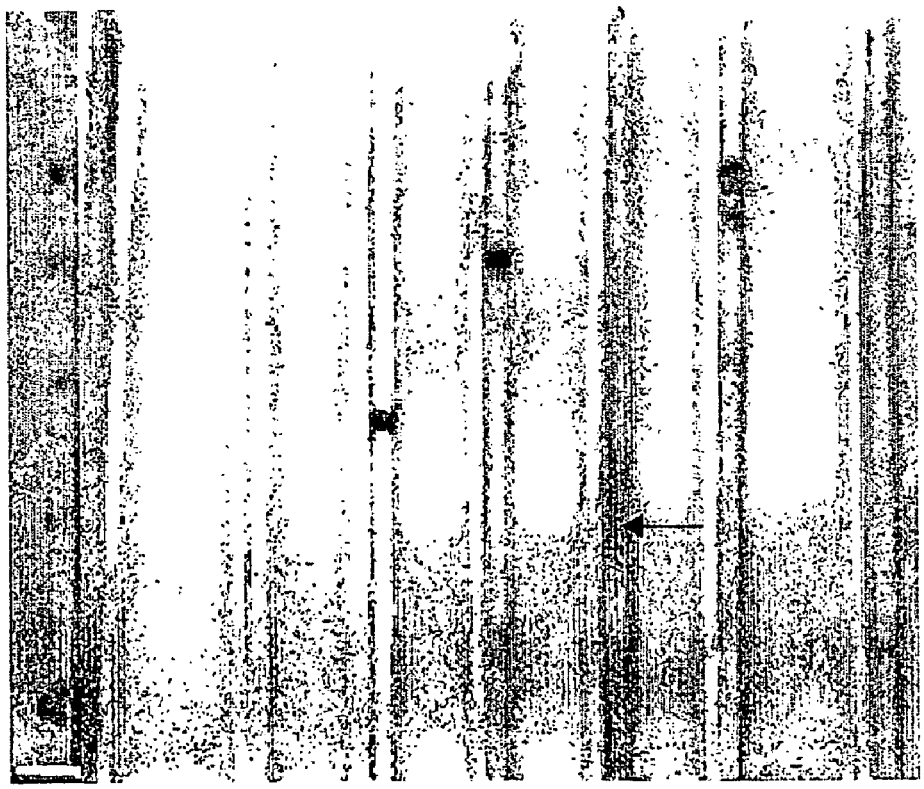
Figure 37C:
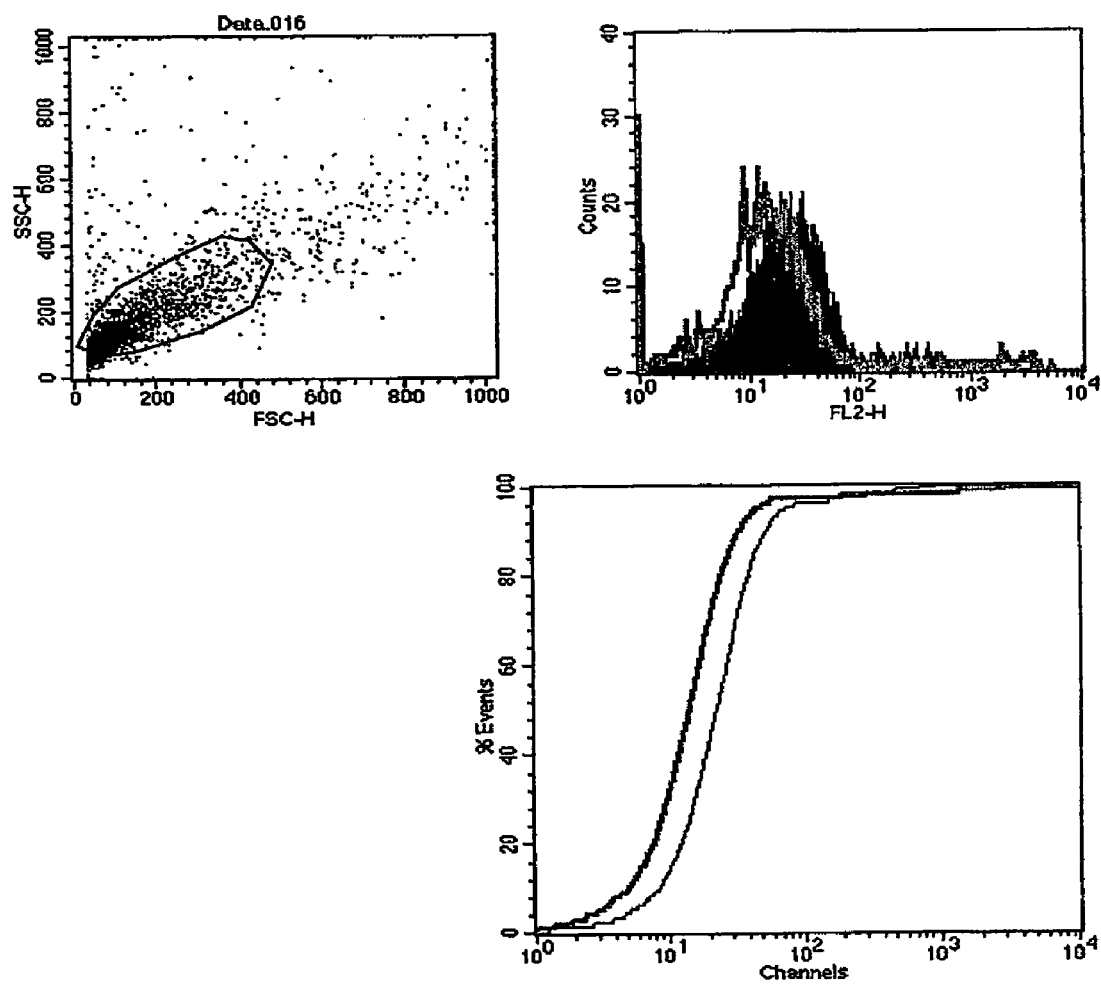

CT600 (SEQ ID 173 and SEQ ID 174) was expressed in *E.coli*. The recombinant product was purified as a His-tagged fusion protein (FIG. 37A: lanes 5, 6 and 7, chromatography fractions 1, 2 and 3, expected molecular weight 19.5 kDa). The recombinant protein was used to immunise mice, whose sera were used in a Western Blot (FIG. 37B, lanes 10 and 11, indicated by arrow) and for FACS analysis (FIG. 37C, K-S value 10.46).

These experiments show that CT600 is a surface-exposed and immunoaccessible protein, and that it is a useful immunogen. These properties are not evident from the sequence alone.

EXAMPLE 38

Figure 38A:
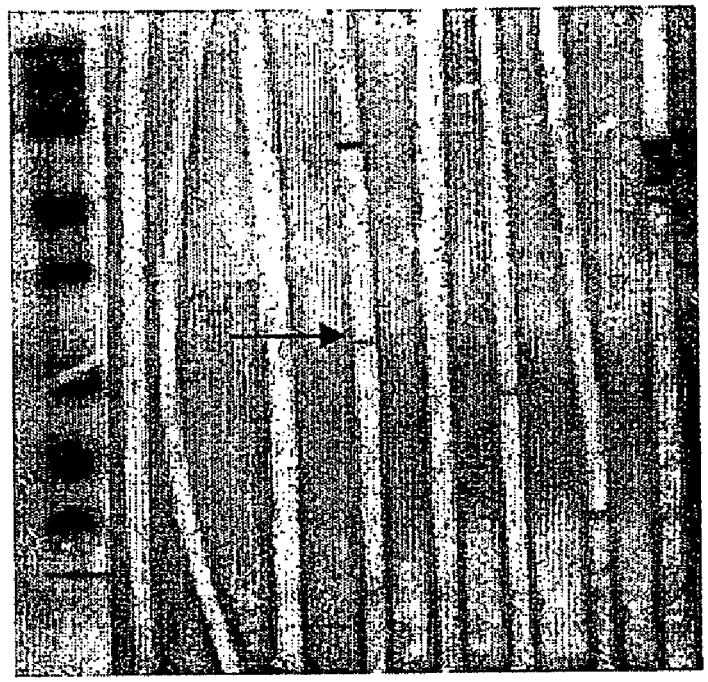
Figure 38B:
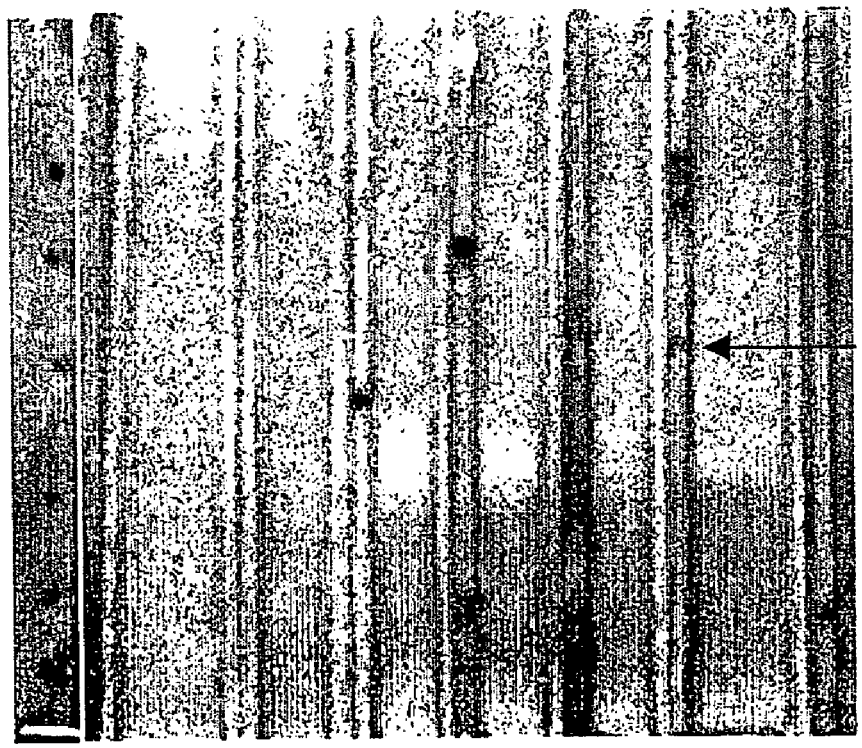
Figure 39:
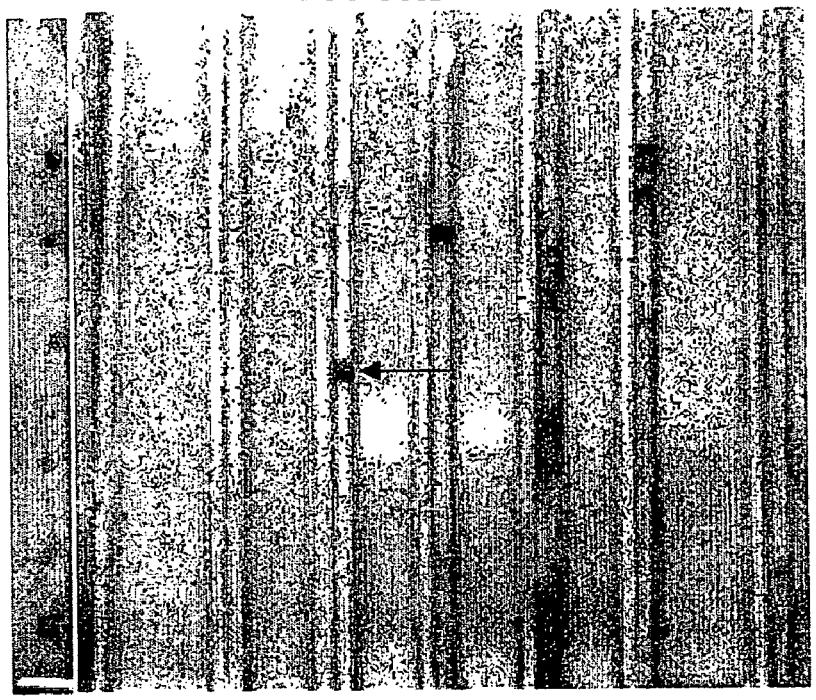
Figure 40:
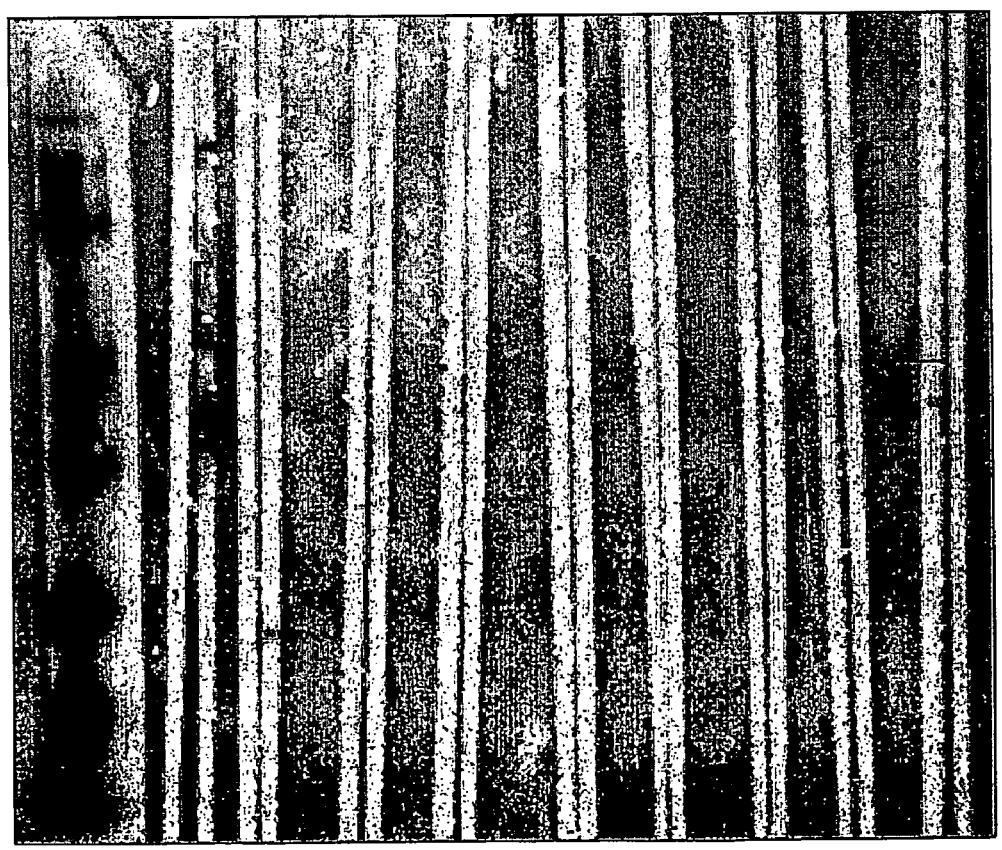
Figure 41:
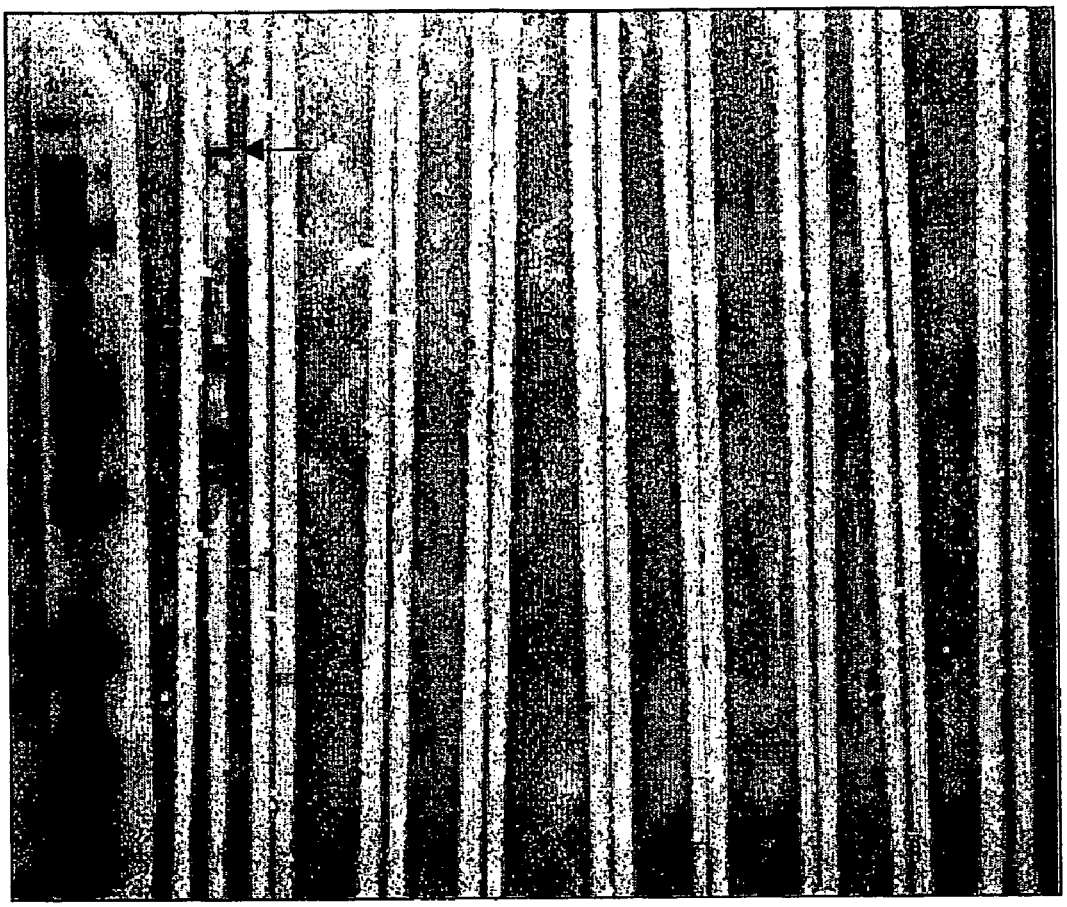
Figure 42:
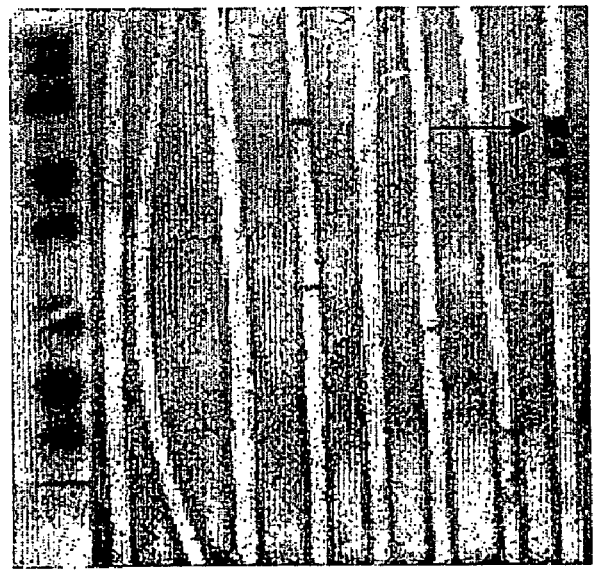
Figure 43:
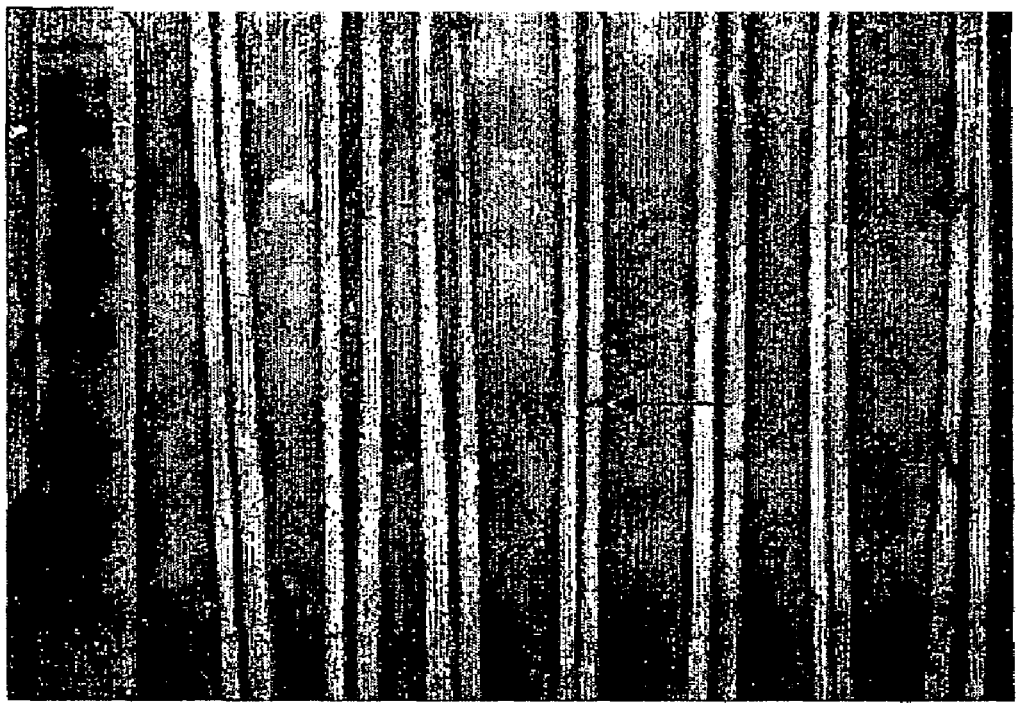

CT279 (SEQ ID 247 and SEQ ID 248) was expressed in *E.coli*. The recombinant product was purified as a GST-tagged fusion protein and as a His-tagged fusion protein. The recombinant His-tagged protein and the recombinant GST-tagged protein were used to immunise mice, whose sera were used in Western blots (FIG. 38A: His-tagged: lane 5 (indicated by an arrow); FIG. 38B: GST-tagged: lanes 12 and 13 (indicated by an arrow)).

EXAMPLE 39

CT560 (SEQ ID 259 and SEQ ID 260) was expressed in *E.coli*. The recombinant product was purified as a His-tagged fusion protein. The recombinant His-tagged protein was used to immunise mice, whose sera were used in a Western blot (FIG. 39: lanes 6 and 7 (indicated by an arrow)).

EXAMPLE 40

CT389 (SEQ ID 249 and SEQ ID 250) was expressed in *E.coli*. The recombinant product was purified as a GST-tagged fusion protein. The recombinant protein was used to immunise mice, whose sera were used in a Western blot (FIG. 40: lanes 16 and 17 (indicated by an arrow)).

EXAMPLE 41

CT456 (SEQ ID 255 and SEQ ID 256) was expressed in *E.coli*. The recombinant product was purified as a GST-tagged fusion protein. The recombinant protein was used to immunise mice, whose sera were used in a Western blot (FIG. 41: lanes 2 and 3 (indicated by an arrow)).

EXAMPLE 42

CT622 (SEQ ID 161 and SEQ ID 162) was expressed in *E.coli*. The recombinant product was purified as a His-tagged fusion protein. The recombinant protein was used to immunise mice, whose sera were used in a Western blot (FIG. 42: lane 9 (indicated by an arrow)).

EXAMPLE 43

CT759 (SEQ ID 213 and SEQ ID 214) was expressed in *E.coli*. The recombinant product was purified as a His-tagged fusion protein. The recombinant protein was used to immunise mice, whose sera were used in a Western blot (FIG. 43: lanes 8 and 9 (indicated by an arrow)).

EXAMPLE 44

Figure 44A:
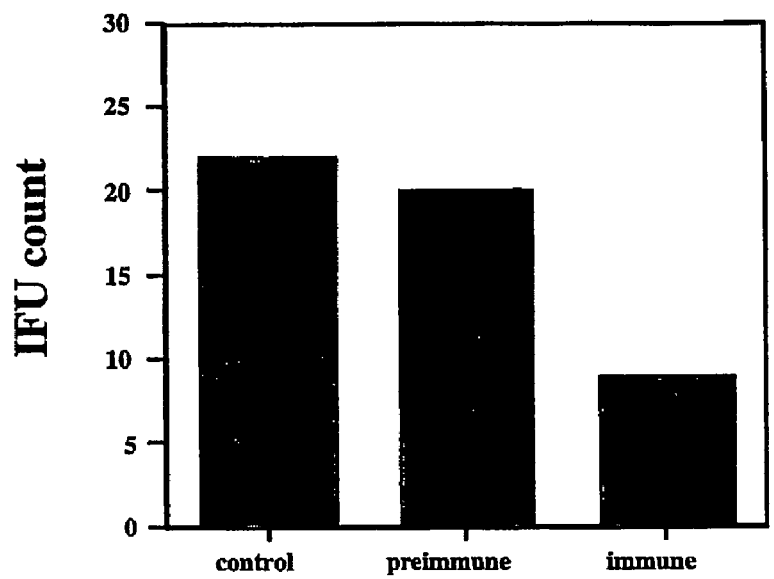
Figure 44B:
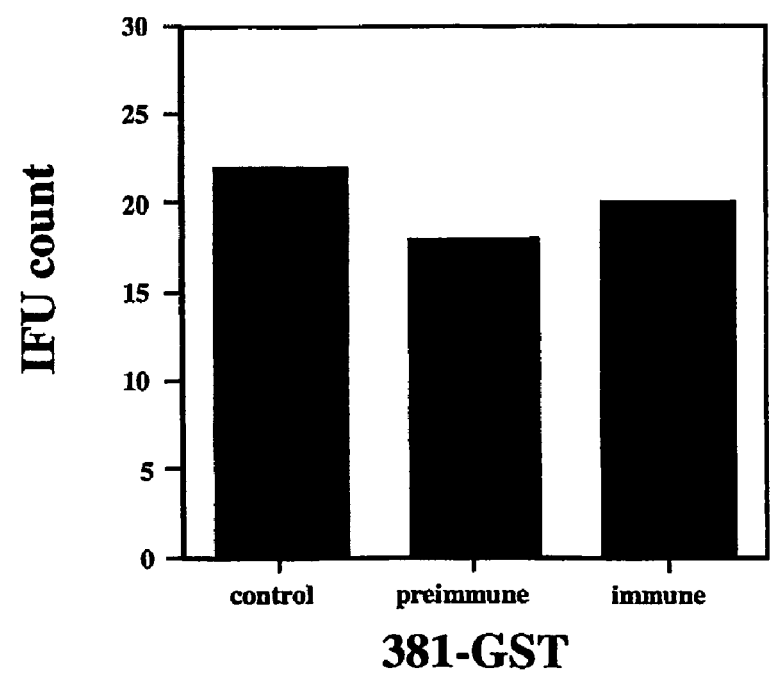

In vitro neutralization assays, which show the ability of sera obtained from mice that have been immunised with the different recombinant proteins of the present invention to inhibit *C.trachomatis* infectivity for eukaryotic cells in culture, were performed using LLCMK2 (Rhesus monkey kidney epithelial) cells. Serial four-fold dilutions of mouse polyclonal sera were prepared in SP (Sucrose-Phosphate) buffer. Mouse antisera to whole EBs were used as a positive control, and preimmune sera and SP buffer alone were used as negative controls. Purified EBs from *C.trachomatis* (serovar D) were diluted in SP buffer to contain 3×10⁵ IFU/ml, and 10 µl of this suspension were added to each serum dilution in a final volume of 100 µl. Antibody-EB interaction was allowed to proceed for 30 min at 37° C. Then 100 µl of reaction mix from each sample were added on top of PBS-washed LLCMK2 cell monolayers, in a 96-well microtiter plate, and centrifuged at 805×g for 1 hour at 37° C. All sera and controls were examined in duplicated samples. After removal of the excess inoculum, the cells were rinsed once with PBS, replenished with 200 µl of DMEM medium supplemented with 20% FCS and 1 µg/ml cycloheximide, and incubated at 37° C. for 48 hours. The cells were fixed with methanol and the typical cytoplasmic inclusions generated by the ongoing intracellular chlamydial infection were stained with an anti-*Chlamydia* fluorescein-conjugated monoclonal antibody (Meridian Diagnostics). At adequate dilutions and EB to host cell ratios, the number of inclusions observed is considered to be equal to the number of viable chlamydiae which were initially capable of successfully establishing a host cell infection (these are named Inclusion Forming Units, IFU). Fluorescein-labelled inclusions were counted in four microscopical fields per well at a magnification of 40×. The inhibition of infectivity due to antibody interaction was calculated as percentage reduction in mean IFU as compared to the SP control (buffer only). According to common practice, the sera were labelled as "neutralzing" if they could cause a 50% or greater reduction in infectivity, however, considering the complexity of the whole screening assay (for instance, a change of host cell, or chlamydial isolate, or a variation in the environmental conditions in the preparation of the infectious inoculum), sera capable of inhibiting EB infectivity to a lower extent should also be considered as vaccine candidates for further study. FIG. 44A shows an example of a result obtained from a neutralisation-positive serum whilst FIG. 44B shows an example of a result obtained from a neutralisation-negative serum.

In vitro neutralization assays were carried out using sera obtained from mice immunised with the recombinant proteins mentioned in Example 1 to 10, 13-22, 24-26 and 29-37. The results are presented in Table II. These results indicate that CT045, CT242, CT381, CT396, CT398, CT467, CT547, CT587 and CT681 are all particularly good candidates for vaccines to prevent infection by *C. trachomatis*. These properties are not evident from the sequences alone.

In further experiments, the sera raised against *C. trachomatis* were tested against *C. pneumoniae* EBs for cross-neutralization activity. The procedure was as described above, but purified EBs from *C. pneumoniae* were diluted in SP buffer to contain $3\times10^6$ IFU/ml, and 10 μl of this suspension were added to each serum dilution in a final volume of 100 μl. Sera obtained using CT242 and CT467 were able to cross-neutralise *C. pneumoniae* EBs.

It will be appreciated that the invention has been described by way of example only and that modifications may be made whilst remaining within the spirit and scope of the invention.

REFERENCES (THE CONTENTS OF WHICH ARE HEREBY INCORPORATED IN FULL)

{1} Raulston (1995) *Mol Microbiol* 15:607-616
{2} Everett (2000) *Vet Microbiol* 75:109-126
{3} Kalman et al. (1999) *Nature Genetics* 21:385-389
{4} Read et al. (2000) *Nucleic Acids Res* 28:1397-1406
{5} Shirai et al. (2000) *Nucleic Acids Res* 28:2311-2314
{6} Stephens et al. (1998) *Science* 282:754-759
{7} International patent application WO99/27105
{8} International patent application WO00/27994
{9} International patent application WO99/28475
{10} Ward (1995) *Apmis.* 103:769-96.
{11} Moulder (1991) *Microbiol Rev* 55(1):143-190.
{12} Comanducci et al. (1994) *Infect Immun* 62(12):5491-5497.
{13} EP-A-0499681
{14} International patent application WO95/28487
{15} Murdin et al. (1993) *Infect Immun* 61:4406-4414
{16} Cerrone et al: (1991) *Infect Immun* 59(1):79-90.
{17} Raulston et al. (1993) *J. Biol. Chem.* 268:23139-23147.
{18} International patent application WO02/02606.

TABLE I

| Ref. 18 | *C. pneumoniae* accession number & annotation | *C. trachomatis* accession number & annotation | SEQ IDs |
|---|---|---|---|
| cp0010 | gi\|4376729\|gb\|AAD18590.1\| Polymorphic Outer Membrane Protein G Family | gi\|3329346\|gb\|AAC68469.1\| Putative Outer Membrane Protein G | 1, 2 |
| cp0014 | gi\|4376729\|gb\|AAD18590.1\| Polymorphic Outer Membrane Protein G Family | gi\|3329346\|gb\|AAC68469.1\| Putative Outer Membrane Protein G | 3, 4 |
| cp0015 | gi\|4376731\|gb\|AAD18591.1\| Polymorphic Outer Membrane Protein G/I Family | gi\|3329346\|gb\|AAC68469.1\| Putative Outer Membrane Protein G | 5, 6 |
| cp0016 | gi\|4376731\|gb\|AAD18591.1\| Polymorphic Outer Membrane Protein G/I Family | gi\|3329350\|gb\|AAC68472.1\| Putative Outer Membrane Protein I | 7, 8 |
| cp0017 | gi\|4376731\|gb\|AAD18591.1\| Polymorphic Outer Membrane Protein G/I Family | gi\|3329346\|gb\|AAC68469.1\| Putative Outer Membrane Protein G | 9, 10 |
| cp0018 | gi\|4376733\|gb\|AAD18593.1\| Polymorphic Outer Membrane Protein G Family | gi\|3328840\|gb\|AAC68009.1\| Putative outer membrane protein A | 11, 12 |
| cp0019 | gi\|4376731\|gb\|AAD18591.1\| Polymorphic Outer Membrane Protein G/I Family | gi\|3329346\|gb\|AAC68469.1\| Putative Outer Membrane Protein G | 13, 14 |
| cp0468 | gi\|4376754\|gb\|AAD18611.1\| Polymorphic Outer Membrane Protein (Frame-shift with C | gi\|3329344\|gb\|AAC68467.1\| Putative Outer Membrane Protein E | 15, 16 |
| cp6260 | gi\|4376260\|gb\|AAD18163.1\| Polymorphic Outer Membrane Protein G Family | gi\|3329346\|gb\|AAC68469.1\| Putative Outer Membrane Protein G | 17, 18 |
| cp6262 | gi\|4376262\|gb\|AAD18165.1\| hypothetical protein | gi\|3328765\|gb\|AAC67940.1\| hypothetical protein | 19, 20 |
| cp6269 | gi\|4376269\|gb\|AAD18171.1\| hypothetical protein | gi\|3328825\|gb\|AAC67995.1\| hypothetical protein | 21, 22 |
| cp6270 | gi\|4376270\|gb\|AAD18172.1\| Polymorphic Outer Membrane Protein G Family | gi\|3329350\|gb\|AAC68472.1\| Putative Outer Membrane Protein I | 23, 24 |

TABLE I-continued

| Ref. 18 | C. pneumoniae accession number & annotation | C. trachomatis accession number & annotation | SEQ IDs |
|---|---|---|---|
| cp6272 | gi|4376272|gb|AAD18173.1| Predicted OMP {leader peptide: outer membrane} | gi|3328772|gb|AAC67946.1| hypothetical protein | 25, 26 |
| cp6273 | gi|4376273|gb|AAD18174.1| Predicted OMP {leader peptide} | gi|3328771|gb|AAC67945.1| hypothetical protein | 27, 28 |
| cp6296 | gi|4376296|gb|AAD18195.1| hypothetical protein | gi|3328520|gb|AAC67712.1| Ribulose-P Epimerase | 29, 30 |
| cp6362 | gi|4376362|gb|AAD18254.1| YbbP family hypothetical protein | gi|3328401|gb|AAC67602.1| hypothetical protein | 31, 32 |
| cp6372 | gi|4376372|gb|AAD18263.1| Signal Peptidase I | gi|3328410|gb|AAC67610.1| Signal Peptidase I | 33, 34 |
| cp6397 | gi|4376397|gb|AAD18286.1| CHLPS hypothetical protein | gi|3328506|gb|AAC67700.1| CHLPS hypothetical protein | 35, 36 |
| cp6402 | gi|4376402|gb|AAD18290.1| ACR family | gi|3328505|gb|AAC67699.1| ACR family | 37, 38 |
| cp6419 | gi|4376419|gb|AAD18305.1| CT149 hypothetical protein | gi|3328551|gb|AAC67740.1| possible hydrolase | 39, 40 |
| cp6446 | gi|4376446|gb|AAD18330.1| hypothetical protein | gi|3329261|gb|AAC68390.1| hypothetical protein | 41, 42 |
| cp6466 | gi|4376466|gb|AAD18348.1| Oligopeptide Binding Protein | gi|3328604|gb|AAC67790.1| Oligopeptide Binding Protein | 43, 44 |
| cp6467 | gi|4376467|gb|AAD18349.1| Oligopeptide Binding Protein | gi|3328604|gb|AAC67790.1| Oligopeptide Binding Protein | 45, 46 |
| cp6468 | gi|4376468|gb|AAD18350.1| Oligopeptide Binding Protein | gi|3328539|gb|AAC67730.1| Oligopeptide Binding Protein | 47, 48 |
| cp6469 | gi|4376469|gb|AAD18351.1| Oligopeptide Binding Protein | gi|3328579|gb|AAC67766.1| Oligopeptide binding protein permease | 49, 50 |
| cp6520 | gi|4376520|gb|AAD18398.1| Polysaccharide Hydrolase-Invasin Repeat Family | gi|3328526|gb|AAC67718.1| predicted polysaccharide hydrolase-invasin repeat family | 51, 52 |
| cp6567 | gi|4376567|gb|AAD18441.1| Inclusion Membrane Protein C | gi|3328642|gb|AAC67825.1| Inclusion Membrane Protein C | 53, 54 |
| cp6576 | gi|4376576|gb|AAD18449.1| Omp85 Analog | gi|3328651|gb|AAC67834.1| Omp85 Analog | 55, 56 |
| cp6577 | gi|4376577|gb|AAD18450.1| (OmpH-Like Outer Membrane Protein) | gi|3328652|gb|AAC67835.1| (OmpH-like Outer Membrane Protein) | 57, 58 |
| cp6601 | gi|4376601|gb|AAD18472.1| Low Calcium Response D | gi|3328486|gb|AAC67681.1| Low Calcium Response D | 59, 60 |
| cp6602 | gi|4376602|gb|AAD18473.1| Low Calcium Response E | gi|3328485|gb|AAC67680.1| Low Calcium Response E | 61, 62 |
| cp6607 | gi|4376607|gb|AAD18478.1| Phopholipase D Superfamily | gi|3328479|gb|AAC67675.1| Phopholipase D Superfamily {leader (33) peptide} | 63, 64 |
| cp6615 | gi|4376615|gb|AAD18485.1| YojL hypothetical protein | gi|3328472|gb|AAC67668.1| hypothetical protein | 65, 66 |
| cp6624 | gi|4376624|gb|AAD18493.1| Solute Protein Binding Family | gi|3328461|gb|AAC67658.1| Solute Protein Binding Family | 67, 68 |
| cp6639 | gi|4376639|gb|AAD18507.1| Flagellar Secretion Protein | gi|3328453|gb|AAC67651.1| Flagellar Secretion Protein | 69, 70 |
| cp6664 | gi|4376664|gb|AAD18529.1| Leucyl Aminopeptidase A | gi|3328437|gb|AAC67636.1| Leucyl Aminopeptidase A | 71, 72 |
| cp6672 | gi|4376672|gb|AAD18537.1| CBS Domain protein (Hemolysin Homolog) | gi|3328667|gb|AAC67849.1| Hypothetical protein containing CBS domains | 73, 74 |
| cp6679 | gi|4376679|gb|AAD18543.1| CT253 hypothetical protein | gi|3328664|gb|AAC67846.1| hypothetical protein | 75, 76 |
| cp6696 | gi|4376696|gb|AAD18559.1| CT266 hypothetical protein | gi|3328678|gb|AAC67859.1| hypothetical protein | 77, 78 |
| cp6717 | gi|4376717|gb|AAD18579.1| Phospholipase D superfamily | gi|3328698|gb|AAC67877.1| Phospholipase D superfamily | 79, 80 |
| cp6727 | gi|4376727|gb|AAD18588.1| Polymorphic Outer Membrane Protein G/I Family | gi|3329346|gb|AAC68469.1| Putative Outer Membrane Protein G | 81, 82 |
| cp6728 | gi|4376728|gb|AAD18589.1| Polymorphic Outer Membrane Protein G Family | gi|3329346|gb|AAC68469.1| Putative Outer Membrane Protein G | 83, 84 |
| cp6729 | gi|4376729|gb|AAD18590.1| Polymorphic Outer Membrane Protein G Family | gi|3329350|gb|AAC68472.1| Putative Outer Membrane Protein I | 85, 86 |
| cp6731 | gi|4376731|gb|AAD18591.1| Polymorphic Outer Membrane Protein G/I Family | gi|3329350|gb|AAC68472.1| Putative Outer Membrane Protein I | 87, 88 |
| cp6733 | gi|4376733|gb|AAD18593.1| Polymorphic Outer Membrane Protein G Family | gi|3328840|gb|AAC68009.1| Putative outer membrane protein A | 89, 90 |
| cp6735 | gi|4376735|gb|AAD18594.1| Polymorphic Outer Membrane Protein (truncated) A/I Fam | gi|3328840|gb|AAC68009.1| Putative outer membrane protein A | 91, 92 |
| cp6736 | gi|4376736|gb|AAD18595.1| Polymorphic Outer Membrane Protein G Family | gi|3329346|gb|AAC68469.1| Putative Outer Membrane Protein G | 93, 94 |
| cp6737 | gi|4376737|gb|AAD18596.1| Polymorphic Outer Membrane Protein H Family | gi|3329347|gb|AAC68470.1| Putative Outer Membrane Protein H | 95, 96 |
| cp6751 | gi|4376751|gb|AAD18608.1| Polymorphic Outer Membrane Protein E Family | gi|3329344|gb|AAC68467.1| Putative Outer Membrane Protein E | 97, 98 |
| cp6752 | gi|4376752|gb|AAD18609.1| Polymorphic Outer Membrane Protein E Family | gi|3329344|gb|AAC68467.1| Putative Outer Membrane Protein E | 99, 100 |
| cp6753 | gi|4376753|gb|AAD18610.1| Polymorphic Outer Membrane Protein E/F Family | gi|3329344|gb|AAC68467.1| Putative Outer Membrane Protein E | 101, 102 |
| cp6757 | gi|4376757|gb|AAD18613.1| hypothetical protein | gi|3328701|gb|AAC67880.1| PP-loop superfamily ATPase | 103, 104 |
| cp6767 | gi|4376767|gb|AAD18622.1| Arginine Periplasmic Binding Protein | gi|3328806|gb|AAC67977.1| Arginine Binding Protein | 105, 106 |
| cp6790 | gi|4376790|gb|AAD18643.1| Heat Shock Protein-70 | gi|3328822|gb|AAC67993.1| HSP-70 | 107, 108 |
| cp6802 | gi|4376802|gb|AAD18654.1| CT427 hypothetical protein | gi|3328857|gb|AAC68024.1| hypothetical protein | 109, 110 |
| cp6814 | gi|4376814|gb|AAD18665.1| CT398 hypothetical protein | gi|3328825|gb|AAC67995.1| hypothetical protein | 111, 112 |

TABLE I-continued

| Ref. 18 | C. pneumoniae accession number & annotation | C. trachomatis accession number & annotation | SEQ IDs |
|---|---|---|---|
| cp6829 | gi\|4376829\|gb\|AAD18679.1\| polymorphic membrane protein A Family | gi\|3328840\|gb\|AAC68009.1\| Putative outer membrane protein A | 113, 114 |
| cp6830 | gi\|4376830\|gb\|AAD18680.1\| polymorphic membrane protein B Family | gi\|3328841\|gb\|AAC68010.1\| Putative outer membrane protein B | 115, 116 |
| cp6832 | gi\|4376832\|gb\|AAD18681.1\| Solute binding protein | gi\|3328844\|gb\|AAC68012.1\| Solute-binding protein | 117, 118 |
| cp6834 | gi\|4376834\|gb\|AAD18683.1\| (Metal Transport Protein) | gi\|3328846\|gb\|AAC68014.1\| (Metal Transport Protein) | 119, 120 |
| cp6847 | gi\|4376847\|gb\|AAD18695.1\| Tail-Specific Protease | gi\|3328872\|gb\|AAC68040.1\| Tail-Specific Protease | 121, 122 |
| cp6848 | gi\|4376848\|gb\|AAD18696.1\| 15 kDa Cysteine-Rich Protein | gi\|3328873\|gb\|AAC68041.1\| 15 kDa Cysteine-Rich Protein | 123, 124 |
| cp6849 | gi\|4376849\|gb\|AAD18697.1\| 60 kDa Cysteine-Rich OMP | gi\|3328874\|gb\|AAC68042.1\| 60 kDa Cysteine-Rich OMP | 125, 126 |
| cp6850 | gi\|4376850\|gb\|AAD18698.1\| 9 kDa-Cysteine-Rich Lipoprotein | gi\|3328876\|gb\|AAC68043.1\| 9 kDa-Cysteine-Rich Lipoprotein | 127, 128 |
| cp6878 | gi\|4376878\|gb\|AAD18723.1\| 2-Component Sensor | gi\|3328901\|gb\|AAC68067.1\| 2-component regulatory system-sensor histidine kinase | 129, 130 |
| cp6879 | gi\|4376879\|gb\|AAD18724.1\| similarity to CHLPS IncA | gi\|3328451\|gb\|AAC67649.1\| hypothetical protein | 131, 132 |
| cp6884 | gi\|4376884\|gb\|AAD18729.1\| CT471 hypothetical protein | gi\|3328905\|gb\|AAC68071.1\| hypothetical protein | 133, 134 |
| cp6886 | gi\|4376886\|gb\|AAD18731.1\| YidD family | gi\|3328908\|gb\|AAC68073.1\| hypothetical protein | 135, 136 |
| cp6890 | gi\|4376890\|gb\|AAD18734.1\| CT476 hypothetical protein | gi\|3328911\|gb\|AAC68076.1\| hypothetical protein | 137, 138 |
| cp6892 | gi\|4376892\|gb\|AAD18736.1\| Oligopeptide Permease | gi\|3328913\|gb\|AAC68078.1\| Oligopeptide Permease | 139, 140 |
| cp6894 | gi\|4376894\|gb\|AAD18738.1\| Oligopeptide Binding Lipoprotein | gi\|3328915\|gb\|AAC68080.1\| oligopeptide Binding Lipoprotein | 141, 142 |
| cp6900 | gi\|4376900\|gb\|AAD18743.1\| Glutamine Binding Protein | gi\|3328922\|gb\|AAC68086.1\| Glutamine Binding Protein | 143, 144 |
| cp6909 | gi\|4376909\|gb\|AAD18752.1\| Protease | gi\|6578107\|gb\|AAC68094.2\| Protease | 145, 146 |
| cp6952 | gi\|4376952\|gb\|AAD18792.1\| Apolipoprotein N-Acetyltransferase | gi\|3328972\|gb\|AAC68136.1\| Apolipoprotein N-Acetyltransferase | 147, 148 |
| cp6960 | gi\|4376960\|gb\|AAD18800.1\| FKBP-type peptidyl-prolyl cis-trans isomerase | gi\|3328979\|gb\|AAC68143.1\| FKBP-type peptidyl-prolyl cis-trans isomerase | 149, 150 |
| cp6968 | gi\|4376968\|gb\|AAD18807.1\| CT547 hypothetical protein | gi\|3328986\|gb\|AAC68149.1\| hypothetical protein | 151, 152 |
| cp6969 | gi\|4376969\|gb\|AAD18808.1\| CT548 hypothetical protein | gi\|3328987\|gb\|AAC68150.1\| hypothetical protein | 153, 154 |
| cp6998 | gi\|4376998\|gb\|AAD18834.1\| Major Outer Membrane Protein | gi\|3329133\|gb\|AAC68276.1\| Major Outer Membrane Protein | 155, 156 |
| cp7005 | gi\|4377005\|gb\|AAD18841.1\| YopC/Gen Secretion Protein D | gi\|3329125\|gb\|AAC68269.1\| probable Yop proteins translocation protein | 157, 158 |
| cp7015 | gi\|4377015\|gb\|AAD18851.1\| FHA domain; (homology to adenylate cyclase) | gi\|3329115\|gb\|AAC68259.1\| (FHA domain; homology to adenylate cyclase) | 159, 160 |
| cp7033 | gi\|4377033\|gb\|AAD18867.1\| CHLPN 76 kDa Homolog_1 (CT622) | gi\|3329069\|gb\|AAC68226.1\| CHLPN 76 kDa Homolog | 161, 162 |
| cp7034 | gi\|4377034\|gb\|AAD18868.1\| CHLPN 76 kDa Homolog_2 (CT623) | gi\|6578109\|gb\|AAC68227.2\| CHLPN 76 kDa Homolog | 163, 164 |
| cp7035 | gi\|4377035\|gb\|AAD18869.1\| Integral Membrane Protein | gi\|3329071\|gb\|AAC68228.1\| Integral Membrane Protein | 165, 166 |
| cp7072 | gi\|4377072\|gb\|AAD18902.1\| CT648 hypothetical protein | gi\|3329097\|gb\|AAC68825.1\| hypothetical protein | 167, 168 |
| cp7073 | gi\|4377073\|gb\|AAD18903.1\| CT647 hypothetical protein | gi\|3329096\|gb\|AAC68824.1\| hypothetical protein | 169, 170 |
| cp7085 | gi\|4377085\|gb\|AAD18914.1\| CT605 hypothetical protein | gi\|3329050\|gb\|AAC68208.1\| hypothetical protein | 171, 172 |
| cp7090 | gi\|4377090\|gb\|AAD18919.1\| Peptidoglycan-Associated Lipoprotein | gi\|3329044\|gb\|AAC68202.1\| Peptidoglycan-Associated Lipoprotein | 173, 174 |
| cp7091 | gi\|4377091\|gb\|AAD18920.1\| macromolecule transporter | gi\|3329043\|gb\|AAC68201.1\| component of a macromolecule transport system | 175, 176 |
| cp7092 | gi\|4377092\|gb\|AAD18921.1\| CT598 hypothetical protein | gi\|3329042\|gb\|AAC68200.1\| hypothetical protein | 177, 178 |
| cp7093 | gi\|4377093\|gb\|AAD18922.1\| Biopolymer Transport Protein | gi\|3329041\|gb\|AAC68199.1\| Biopolymer Transport Protein | 179, 180 |
| cp7094 | gi\|4377094\|gb\|AAD18923.1\| Macromolecule transporter | gi\|3329040\|gb\|AAC68198.1\| polysaccharide transporter | 181, 182 |
| cp7101 | gi\|4377101\|gb\|AAD18929.1\| CT590 hypothetical protein | gi\|3329033\|gb\|AAC68192.1\| hypothetical protein | 183, 184 |
| cp7102 | gi\|4377102\|gb\|AAD18930.1\| CT589 hypothetical protein | gi\|3329032\|gb\|AAC68191.1\| hypothetical protein | 185, 186 |
| cp7106 | gi\|4377106\|gb\|AAD18933.1\| hypothetical protein | gi\|3328796\|gb\|AAC67968.1\| hypothetical protein | 187, 188 |
| cp7111 | gi\|4377111\|gb\|AAD18938.1\| Enolase | gi\|3329030\|gb\|AAC68189.1\| Enolase | 189, 190 |
| cp7127 | gi\|4377127\|gb\|AAD18953.1\| General Secretion Protein D | gi\|3329013\|gb\|AAC68174.1\| Gen. Secretion Protein D | 191, 192 |
| cp7130 | gi\|4377130\|gb\|AAD18956.1\| predicted OMP {leader peptide} | gi\|3329010\|gb\|AAC68171.1\| predicted OMP | 193, 194 |
| cp7132 | gi\|4377132\|gb\|AAD18958.1\| CT567 hypothetical protein | gi\|3329008\|gb\|AAC68169.1\| hypothetical protein | 195, 196 |
| Cp7133 | gi\|4377133\|gb\|AAD18959.1\| CT566 hypothetical protein | gi\|3329007\|gb\|AAC68168.1\| hypothetical protein | 197, 198 |
| Cp7140 | gi\|4377140\|gb\|AAD18965.1\| Yop Translocation J | gi\|3329000\|gb\|AAC68161.1\| Yop proteins translocation lipoprotein J | 199, 200 |
| Cp7170 | gi\|4377170\|gb\|AAD18992.1\| Outer Membrane Protein B | gi\|3329169\|gb\|AAC68308.1\| Outer Membrane Protein Analog | 201, 202 |
| Cp7177 | gi\|4377177\|gb\|AAD18998.1\| Flagellar M-Ring Protein | gi\|3329175\|gb\|AAC68314.1\| Flagellar M-Ring Protein | 203, 204 |
| Cp7182 | gi\|4377182\|gb\|AAD19003.1\| CT724 hypothetical protein | gi\|3329181\|gb\|AAC68319.1\| hypothetical protein | 205, 206 |
| Cp7184 | gi\|4377184\|gb\|AAD19005.1\| Rod Shape Protein | gi\|3329183\|gb\|AAC68321.1\| Rod Shape Protein | 207, 208 |
| Cp7193 | gi\|4377193\|gb\|AAD19013.1\| CT734 hypothetical protein | gi\|3329192\|gb\|AAC68329.1\| hypothetical protein | 209, 210 |
| Cp7206 | gi\|4377206\|gb\|AAD19025.1\| CHLTR possible phosphoprotein | gi\|3329204\|gb\|AAC68339.1\| CHLTR possible phosphoprotein | 211, 212 |
| Cp7222 | gi\|4377222\|gb\|AAD19040.1\| Muramidase (invasin repeat family) | gi\|3329221\|gb\|AAC68354.1\| Muramidase (invasin repeat family) | 213, 214 |

TABLE I-continued

| Ref. 18 | C. pneumoniae accession number & annotation | C. trachomatis accession number & annotation | SEQ IDs |
|---|---|---|---|
| Cp7223 | gi\|4377223\|gb\|AAD19041.1\| Cell Division Protein FtsW | gi\|3329222\|gb\|AAC68355.1\| Cell Division Protein FtsW | 215, 216 |
| Cp7224 | gi\|4377224\|gb\|AAD19042.1\| Peptidoglycan Transferase | gi\|3329223\|gb\|AAC68356.1\| Peptidoglycan Transferase | 217, 218 |
| Cp7225 | gi\|4377225\|gb\|AAD19043.1\| Muramate-Ala Ligase & D-Ala-D-Ala Ligase | gi\|3329224\|gb\|AAC68357.1\| UDP-N-acetylmuramate-alanine ligase | 219, 220 |
| Cp7248 | gi\|4377248\|gb\|AAD19064.1\| Thioredoxin Disulfide Isomerase | gi\|3329244\|gb\|AAC68375.1\| Thioredoxin Disulfide Isomerase | 221, 222 |
| Cp7261 | gi\|4377261\|gb\|AAD19076.1\| CT788 hypothetical protein -{leader peptide-periplasmi | gi\|3329253\|gb\|AAC68383.1\| {leader (60) peptide-periplasmic} | 223, 224 |
| Cp7280 | gi\|4377280\|gb\|AAO19093.1\| Insulinase family/Protease III | gi\|3329273\|gb\|AAC68402.1\| Insulinase family/Protease III | 225, 226 |
| Cp7287 | gi\|4377287\|gb\|AAD19099.1\| Putative Outer Membrane Protein D Family | gi\|3329279\|gb\|AAC68408.1\| Putative Outer Membrane Protein D | 227, 228 |
| Cp7306 | gi\|4377306\|gb\|AAD19116.1\| DO Serine Protease | gi\|3329293\|gb\|AAC68420.1\| DO Serine Protease | 229, 230 |
| Cp7342 | gi\|4377342\|gb\|AAD19149.1\| ABC transporter permease | gi\|3329327\|gb\|AAC68451.1\| ABC transporter permease - pyrimidine biosynthesis protein | 231, 232 |
| Cp7347 | gi\|4377347\|gb\|AAD19153.1\| CT858 hypothetical protein | gi\|6578118\|gb\|AAC68456.2\| predicted Protease containing IRBP and DHR domains | 233, 234 |
| Cp7353 | gi\|4377353\|gb\|AAD19159.1\| CT863 hypothetical protein | gi\|3329337\|gb\|AAC68461.1\| hypothetical protein | 235, 236 |
| Cp7367 | gi\|4377367\|gb\|AAD19171.1\| Predicted OMP | gi\|3328795\|gb\|AAC67967.1\| hypothetical protein | 237, 238 |
| Cp7408 | gi\|4377408\|gb\|AAD19209.1\| hypothetical protein | gi\|3328795\|gb\|AAC67967.1\| hypothetical protein | 239, 240 |
| Cp7409 | gi\|4377409\|gb\|AAD19210.1\| Predicted Outer Membrane Protein (CT371) | gi\|3328795\|gb\|AAC67967.1\| hypothetical protein | 241, 242 |
| | gi\|4376411\|gb\| | gi\|3328512\|gb\|AAC67705.1\| hypothetical protein | 243, 244 |
| | gi\|4376508\|gb\| | gi\|3328585\|gb\|AAC67772.1\| hypothetical protein | 245, 246 |
| | gi\|4376710\|gb\| | gi\|3328692\|gb\|AAC67872.1\| NADH (Ubiquinone) Oxidoreductase, Gamma | 247, 248 |
| | gi\|4376777\|gb\| | gi\|3328815\|gb\|AAC67986.1\| hypothetical protein | 249, 250 |
| | gi\|4376782\|gb\| | gi\|3328817\|gb\|AAC67988.1\| hypothetical protein | 251, 252 |
| | gi\|4376863\|gb\| | gi\|3328887\|gb\|AAC68054.1\| Arginyl tRNA transferase | 253, 254 |
| | gi\|4376866\|gb\| | gi\|3328889\|gb\|AAC68056.1\| hypothetical protein | 255, 256 |
| | gi\|4376972\|gb\| | gi\|3328991\|gb\|AAC68153.1\| D-Ala-D-Ala Carboxypeptidase | 257, 258 |
| | gi\|4377139\|gb\| | gi\|3329001\|gb\|AAC68162.1\| hypothetical protein | 259, 260 |
| | gi\|4377154\|gb\| | gi\|3329154\|gb\|AAC68295.1\| hypothetical protein | 261, 262 |

TABLE II

| CT | Fusion type | 50% neutralization titer | % neutralization of EB infectivity for LLCMK2 cell cultures at specified serum dilutions | | | |
|---|---|---|---|---|---|---|
| | | | 1/40 | 1/160 | 1/640 | 1/2560 |
| CT045 | HIS | 1:160 | 32 | 50 | 18 | |
| CT089 | HIS | | 44 | 37 | 0 | |
| | GST | | 6 | 25 | 37 | |
| CT114 | HIS | | 0 | 18 | | |
| CT181 | GST | | 19 | 0 | | |
| CT198 | HIS | | 19 | 0 | 13 | |
| CT241 | HIS | | 5 | 42 | | |
| CT242 | HIS | 1:100 | 58 | 45 | 0 | |
| | GST | | 46 | 24 | 40 | |
| CT350 | GST | | 0 | 39 | | |
| CT351 | HIS | | 1 | 5 | | |
| CT381 | HIS | 1:450 | 67 | 56 | 48 | |
| | GST | | 24 | 0 | 0 | |
| CT391 | HIS | | 0 | 14 | | |
| CT396 | HIS | 1:300 | 55 | 62 | 35 | |
| | GST | | 8 | 33 | 25 | |
| CT398 | HIS | 1:640 | 57 | 45 | 50 | |
| | GST | 1:>640 | 68 | 60 | 60 | |
| CT415 | GST | | 21 | 21 | | |
| CT427 | HIS | | 25 | 13 | 13 | |
| CT443 | HIS | | 25 | 25 | | |
| CT454 | HIS | | 16 | 4 | | |
| CT467 | GST | 1:1100 | 65 | 67 | 62 | 48 |
| CT541 | GST | | 10 | 24 | 13 | |
| CT547 | HIS | 1:40 | 50 | 13 | 18 | |
| | GST | | 0 | 0 | 18 | |
| CT551 | HIS | | 5 | 11 | | |
| CT559 | HIS | | 20 | 23 | | |
| CT567 | | | 0 | 26 | | |
| CT569 | HIS | | 0 | 5 | | |
| CT587 | HIS | 1:1200 | 51 | 61 | 56 | 42 |
| CT589 | HIS | | 37 | 21 | | |
| | GST | | 0 | 33 | | |
| CT597 | GST | | 0 | 4 | | |
| CT600 | HIS | | 0 | 11 | | |
| CT647 | GST | | 15 | 0 | | |
| CT681 | HIS | 1:160 | 95 | 53 | | |
| CT713 | HIS | | 10 | 10 | | |
| CT761 | GST | | 0 | 16 | | |
| CT823 | HIS | | 5 | 23 | | |
| NN-GST | | | 0 | 0 | 0 | |
| NN-HIS | | | 0 | 0 | 0 | |

SEQUENCE LISTING (262 sequences)

SEQ ID NO: 1 - protein, 1013 aa, Chlamydia trachomatis
MQTSFHKFFLSMLLAYSCCSLSGGGYAAEIMIPQGIYDGETLTVSFPYTVIGDPSGTTVFSAGELTLKNLDNSLAALPLSCFGNLLGSFTVLGRGHSLTFENIRTSTNGAALSDSANSGLFTIEGFKELSFSNCNSLLAVLPAATTNNGSQTPTTTSTPSNGTIYSKTDLLLLNNEKFSFYSNLVSGDGGAIDAKSLTVQGISKLCVFQENTAQADGGACQVVTSFSAMANEAPIAFIANVAGVRGGGLAAVQDGQQGVSSSTSTEDPVVSFSRNTAVEFDGNVARVGGGIYSYGNVAFLNNGKTLFLNNVASPVYLAAEQPTNGQASNTSDNYGDGGAIFCKNGAQAAGSNNSGSVSFDGEGVVFFSSNVAAGKGGAIYAKKLSVANCGPVQFLGNIANDGGAIYLGESGELSLSADYGDIIFDGNLKRTAKENAADVNGVTVSSQAISMGSGGKITTLRAKAGHQILFNDPIEMANGNNQPAQSSEPLKINDGEGYTGDIVFANGNSTLYQNVTIEQGRIVLREKAKLSVNSLSQTGGSLYMEAGSTLDFVTPQPPQQPPAANQLITLSNLHLSLSSLLANNAVTNPPTNPPAQDSHPAIIGSTTAGSVTISGPIFFEDLDDTAYDRYDWLGSNQKIDVLKLQLGTQPSANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTKQALCGSYLFGDAFLRASYGFGNQHMKTSYTFAEESDVRWDNNCLVGEIGVGLPIVITPSKLYLNELRPFVQAEFSYADHESFTEEGDQARAFRSGHLMNLSVPVGVKFDRCSSTHPNKYSFMGAYICDAYRTISGTQTTLLSHQETWTTDAFHLARHGVIVRGSMYASLTSNIEVYGHGRYEYRDTSRGYGLSAGSKVRF

SEQ ID NO: 2 - DNA, 3042 bp, Chlamydia trachomatis
atgcaaacgtctttccataagttctttctttcaatgattctagcttattcttgctgctctttaagtgggggggggtatgcagcagaaatcatgattcctcaaggaatttacgatggggagacgttaactgtatcatttccctatactgttataggagatccgagtgggactactgttttttctgcaggagagttaacgttaaaaaatcttgacaattctattgcagctttgcctttaagttgttttgggaacttattagggagttttactgttttagggagaggacactcgttgactttcgagaacatacggacttctacaaatggagctgcactaagtgacagcgctaatagcgggttatttactattgagggttttaaagaattatctttttccaattgcaactcattacttgccgtactgcctgctgcaacgactaataatggtagccagactccgacgacaacatctacaccgtctaatggtactatttattctaaaacagatcttttgttactcaataatgagaagttctcattctatagtaatttagtctctggagatgggggagctatagatgctaagagcttaacggttcaaggaattagcaagctttgtgtcttccaagaaaatactgctcaagctgatgggggagcttgtcaagtagtcaccagtttctctgctatggctaacgaggctcctattgcctttatagcgaatgttgcaggagtaagagggggagggattgctgctgttcaggatgggcagcagggagtgtcatcatctacttcaacagaagatccagtagtaagtttttccagaaatactgcggtagagtttgatgggaacgtagcccgagtaggaggagggatttactcctacgggaacgttgctttcctgaataatggaaaaaccttgtttctcaacaatgttgcttctcctgtttacattgctgctgagcaaccaacaaatggacaggcttctaatacgagtgataattacggagatggaggagctatcttctgtaagaatggtgcgcaagcagcaggatccaataactctggatcagtttcctttgatggagagggagtagttttctttagtagcaatgtagctgctgggaaagggggagctatttatgccaaaaagctctcggttgctaactgtggccctgtacaattcttagggaatatcgctaatgatggtggagcgatttatttaggagaatctggagagctcagtttatctgctgattatggagatattattttcgatgggaatcttaaaagaacagccaaagagaatgctgccgatgttaatggcgtaactgtgtcctcacaagccatttcgatgggatcgggagggaaaataacgacattaagagctaaagcagggcatcagattctctttaatgatcccatcgagatggcaaacggaaataaccagccagcgcagtcttccgaacctctaaaaattaacgatggtgaaggatacacaggggatattgtttttgctaatggaaacagtactttgtaccaaaatgttacgatagagcaaggaaggattgttcttcgtgaaaaggcaaaattatcagtgaattctctaagtcagacaggtgggagtctgtatatggaagctgggagtacattggattttgtaactccacaaccaccacaacagcctcctgccgctaatcagttgatcacgctttccaatctgcatttgtctctttcttctttgttagcaaacaatgcagttacgaatcctcctaccaatcctccagcgcaagattctcatcctgcaatcattggtagcacaactgctggttctgttacaattagtgggcctatcttttttgaggatttggatgatacagcttatgataggtatgattggctaggttctaatcaaaaaatcgatgtcctgaaattacagttagggactcagccctcagctaatgccccatcagatttgactctagggaatgagatgcctaagtatggctatcaaggaagctggaagcttgcgtgggatcctaatacagcaaataatggtccttatactctgaaagctacatggactaaaactgggtataatcctgggcctgagcgagtagcttctttggttccaaatagtttatggggatccattttagatatacgatctgcgcattcagcaattcaagcaagtgtggatgggcgctcttattgtcgaggattatgggtttctggagtttcgaatttcttctatcatgaccgcgatgctttaggtcagggatatcggtatattagtgggggttattccttaggagcaaactcctactttggatcatcgatgtttggtctagcatttaccgaagtatttggtagatctaaagattatgtagtgtgtcgttccaatcatcatgcttgcataggatccgtttatctatctaccaaacaagctttatgtggatcctatttgttcggagatgcgtttatccgtgctagctacgggtttgggaaccagcatatgaaaacctcatacacatttgcagaggagagcgatgttcgttgggataataactgtctggttggagagattggagtgggattaccgattgtgattactccatctaagctctatttgaatgagttgcgtcctttcgtgcaagctgagttttcttatgccgatcatgaatcttttacagaggaaggcgatcaagctcgggcattcaggagtggacatctcatgaatctatcagttcctgttggagtaaaatttgatcgatgttctagtacacaccctaataaatatagctttatgggggcttatatctgtgatgcttatcgcaccatctctgggactcagacaacactcctatcccatcaagagacatggacaacagatgcctttcatttggcaagacatggagtcatagttagagggtctatgtatgcttctctaacaagcaatatagaagtatatggccatggaagatatgagtatcgagatacttctcgaggttatggtttgagtgcaggaagtaaagtccggttctaa

SEQ ID NO: 3 - protein, 1013 aa, Chlamydia trachomatis; identical to SEQ ID NO: 1

SEQ ID NO: 4 - DNA, 3042 bp, Chlamydia trachomatis; identical to SEQ ID NO: 2

SEQ ID NO: 5 - protein, 1013 aa, Chlamydia trachomatis
MQTSFHKFFLSMILAYSCCSLSGGGYAAEIMIPQGIYDGETLTVSFPYTVIGDPSGTTVFSAGELTLKNLDNSIAALPLSCFGNLLGSFTVLGRGHSLTFENIRTSTNGAALSDSANSGLFTIEGFKELSFSNCNSLLAVLPAATTNNGSQTPTTTSTPSNGTIYSKTDLLLLNNEKFSFYSNLVSGDGGAIDAKSLTVQGISKLCVFQENTAQADGGACQVVTSFSAMANEAPIAFIANVAGVRGGGIAAVQDGQQGVSSSTSTEDPVVSFSRNTAVEFDGNVARVGGGIYSYGNVAFLNNGKTLFLNNVASPVYIAAEQPTNGQASNTSDNYGDGGAIFCKNGAQAAGSNNSGSVSFDGEGVVFFSSNVAAGKGGAIYAKKLSVANCGPVQFLGNIANDGGAIYLGESGELSLSADYGDIIFDGNLKRTAKENAADVNGVTVSSQAISMGSGGKITTLRAKAGHQILFNDPIEMANGNNQPAQSSEPLKINDGEGYTGDIVFANGNSTLYQNVTIEQGRIVLREKAKLSVNSLSQTGGSLYMEAGSTLDFVTPQPPQQPPAANQLITLSNLHLSLSSLLANNAVTNPPTNPPAQDSHPAIIGSTTAGSVTISGPIFFEDLDDTAYDRYDWLGSNQKIDVLKLQLGTQPSANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTKQALCGSYLFGDAFIRASYGFGNQHMKTSYTFAEESDVRWDNNCLVGEIGVGLPIVITPSKLYLNELRPFVQAEFSYADHESFTEEGDQARAFRSGHLMNLSVPVGVKFDRCSSTHPNKYSFMGAYICDAYRTISGTQTTLLSHQETWTTDAFHLARHGVIVRGSMYASLTSNIEVYGHGRYEYRDTSRGYGLSAGSKVRF

SEQ ID NO: 6 - DNA, 3042 bp, Chlamydia trachomatis; identical to SEQ ID NO: 2

SEQ ID NO: 7 - protein, 878 aa, Chlamydia trachomatis
MRPDHMNFCCLCAAILSSTAVLFGQDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSILAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLLMEAGTSLKTSSDLKLATLSIPLHSLDTEKSVTLHAPNLSIQKIFLSNSGDENFYENVELLSKEQNNIPLLTLSKEQSHLHLPDGNLSSHFGYQGDWTFSWKDSDEGHSLIANWTPKNYVPHPERQSTLVANTLWNTYSDMQAVQSMINTIAHGGAYLFGTWGSAVSNLFYAHDSSGKPIDNWHHRSLGYLFGISTHSLDDHSFCLAAGQLLGKSSDSFITSTETTSYIATVQAQLATPLMKISAQACYNESIHELKTKYRSFSKEGFGSWHSVAVSGEVCASIPIVSNGSGLFSSFSIFSKLQGFSGTQDGFEESSGEIRSFSASSFRNISLPMGITFEKKSQKTRNYYYFLGAYIQDLKRDVESGPVVLLKNAVSWDAPMANLDSRAYMFRLTNQRALHRLQTLLNVSYVLRGQSHSYSLDLGTTYRF

SEQ ID NO: 8 - DNA, 2637 bp, Chlamydia trachomatis
atgcgacctgatcatatgaacttctgttgtctatgtgctgctattttgtcatccacagcggtcctctttggccaggatcccttaggtgaaaccgccctcctcactaaaaatcctaatcatgtcgtctgtacattttttgaggactgtaccatggagagcctctttcctgctctttgtgctcatgcatcacaagatgatcctttgtatgtacttggaaattcctactgttggttcgtatctaaactccatatcacggaccccaaagaggctctttttaaagaaaaaggagatctttccattcaaaattttcgcttcctttccttcacagattgctcttccaaggaaagctctccttctattattcatcaaaagaatggtcagttatccttgcgcaataatggtagcatgagtttctgtcgaaatcatgctgaaggctctggaggagccatctctgcggatgccttttctctacaacacaactatcttttcacagcttttgaagagaattcttctaaaggaaatggcggagccattcaggctcaaaccttctctttatctagaaatgtgtcgcctatttctttcgcccgtaatcgtgcggatttaaatggcggcgctatttgctgtagtaatcttatttgttcagggaatgtaaaccctctctttttcactggaaactccgccacgaatggaggcgctatttgttgtatcagcgatctaaacacctcagaaaaaggctctctctctcttgcttgtaaccaagaaacgctatttgcaagcaattctgctaaagaaaaaggcggggctatttatgccaagcacatggtattgcgttataacggtcctgtttccttcattaacaacagcgctaaaataggtggagctatcgccatccagtccggagggagtctctctatccttgcaggtgaaggatctgttctgttccagaataactcccaacgcacctccgaccaaggtctagtaagaaacgccatctacttagagaaagatgcgattctttcttccttagaagctcgcaacggagatattcttttctttgatcctattgtacaagaaagtagcagcaaagaatcgcctcttccctcctctttgcaagccagcgtgacttctcccaccccagccaccgcatctcctttagttattcagacaagtgcaaaccgttcagtgattttctcgagcgaacgtctttctgaagaagaaaaaactcctgataacctcacttcccaactacagcagcctatcgaactgaaatccggacgcttagttttaaaagatcgcgctgtcctttccgcgccttctctctctcaggatcctcaagctctcctcattatggaagcgggaacttctttaaaaacttcctctgatttgaagttagctacgctaagtattccccttcattccttagatactgaaaaaagcgtaactatccacgcccctaacctttctatccaaaagatcttcctctctaattctggagatgagaatttttatgaaaatgtagagcttctcagtaaagagcaaaacaatattcctctccttactctctctaaagagcaatctcatttacatcttcctgatgggaacctctcttctcactttggatatcaaggagattggactttttcttggaaagattctgatgaagggcattctctgattgctaattggacgcctaaaaactatgtgcctcatccagaacgtcaatctacactcgttgcgaacactctttggaacacctattccgatatgcaagctgtgcagtcgatgattaatacaatagcgcacggaggagcctatctatttggaacgtggggatctgctgtttctaatttattctatgctcacgacagctctgggaaacctatcgataattggcatcatagaagccttggctacctattcggtatcagtactcacagtttagatgaccattctttctgcttggctgcaggacaattactcgggaaatcgtccgattcctttattacgtctacagaaacgacctcctatatagctactgtacaagcgcaactcgctacccctctaatgaaaatctctgcacaggcatgctataatgaaagtatccatgagctaaaaacaaaatatcgctccttctctaaagaaggattcggatcctggcatagcgttgcagtatccggagaagtgtgcgcatcgattcctattgtatccaatggttccggactgttcagctccttctctattttctctaaactgcaaggattttcaggaacacaggacggttttgaggagagttcgggagagattcggtccttttctgccagctctttcagaaatatttcacttcctatgggaataacatttgaaaaaaaatcccaaaaaacacgaaactactattactttctgggagcctacatccaagacctaaaacgtgatgtggaatcgggacctgtagtgttactcaaaaatgccgtctcctgggatgctcctatggcgaacttggattcgcgagcctacatgttcaggcttacgaatcaaagagctctgcatagacttcagacgctgttaaatgtgtcttacgtactgcgcgggcaaagccatagttactccctggatctggggaccacttacaggttctag

SEQ ID NO: 9 - protein, 1013 aa, Chlamydia trachomatis
MQTSFHKFFLSMILAYSCCSLSGGGYAAEIMIPQGIYDGETLTVSFPYTVIGDPSGTTVFSAGELTLKNLDNSLAALPLSCFGNLLGSFTVLGRGHSLTFENIRTSTNGAALSDSANSGLFTIEGFKELSFSNCNSLLAVLPAATTNNGSQTPTTTSTPSNGTIYSKTDLLLLNNEKFSFYSNLVSGDGGAIDAKSLTVQGISKLCVFQENTAQADGGACQVVTSFSAMANEAPIAFIANVAGVRGGGLAAVQDGQQGVSSSTSTEDPVVSFSRNTAVEFDGNVARVGGGIYSYGNVAFLNNGKTLFLNNVASPVYLAAEQPTNGQASNTSDNYGDGGAIFCKNGAQAAGSNNSGSVSFDGEGVVFFSSNVAAGKGGAIYAKKLSVANCGPVQFLGNIANDGGAIYLGESGELSLSADYGDIIFDGNLKRTAKENAADVNGVTVSSQAISMGSGGKITTLRAKAGHQILFNDPIEMANGNNQPAQSSEPLKINDGEGYTGDIVFANGNSTLYQNVTIEQGRIVLREKAKLSVNSLSQTGGSLYMEAGSTLDFVTPQPPQQPPAANQLITLSNLHLSLSSLLANNAVTNPPTNPPAQDSHPAIIGSTTAGSVTISGPIFFEDLDDTAYDRYDWLGSNQKIDVLKLQLGTQPSANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTKQALCGSYLFGDAFLRASYGFGNQHMKTSYTFAEESDVRWDNNCLVGEIGVGLPIVITPSKLYLNELRPFVQAEFSYADHESFTEEGDQARAFRSGHLMNLSVPVGVKFDRCSSTHPNKYSFMGAYICDAYRTISGTQTTLLSHQETWTTDAFHLARHGVIVRGSMYASLTSNIEVYGHGRYEYRDTSRGYGLSAGSKVRF

SEQ ID NO: 10 - DNA, 3042 bp, Chlamydia trachomatis; identical to SEQ ID NO: 2

SEQ ID NO: 11 - protein, 975 aa, Chlamydia trachomatis
MNRVIELHAHYDQRQLSQSPNTNFLVHHPYLTLIPKFLLGALIVYAPYSFAEMELALSGHKQGKDRDTFTMISSCPEGTNYIINRKLILSDFSLLNKVSSGGAFRNLAGKISFLGKNSSASIHFKHININGFGAGVFSESSIEFTDLRKLVAFGSESTGGIFTAKEDISFKNNHHIAFRNNITKGNGGVIQLQGDMKGSVSFVDQRGAIIFTNNQAVTSSSMKHSGRGGAISGDFAGSRILFLNNQQITFEGNSAVHGGAIYNKNGLVEFLGNAGPLAFKENTTIANGGAIYTSNFKANQQTSPILFSQNHANKKGGAIYAQYVNLEQNQDTIRFEKNTAKEGGGAITSSQCSITAHNTIIFSDNAAGDLGGGAILLEGKKPSLTLIAHSGNIAFSGNTMLHITKKASLDRHNSILIKEAPYKIQLAANKNHSIHFFDPVMALSASSSPIQINAPEYETPFFSPKGMIVFSGANLLDDAREDVANRTSIFNQPVHLYNGTLSIENGAHLIVQSFKQTGGRISLSPGSSLALYTMNSFFHGNISSKEPLEINGLSFGVDISPSNLQAELRAGNAPLRLSGSPSIHDPEGLFYENRDTAASPYQMEILLTSDKIVDISKFTTDSLVTNKQSGFQGAWHFSWQPNTINNTKQKILRASWLPTGEYVLESNRVGRAVPNSLWSTFLLLQTASHNLGDHLCNNRSLIPTSYFGVLIGGTGAEMSTHSSEEESFISRLGATGTSIIRLTPSLTLSGGGSHMFGDSFVADLPEHITSEGIVQNVGLTHVWGPLTVNSTLCAALDHNAMVRICSKKDHTYGKWDTFGMRGTLGASYTFLEYDQTMRVFSFANIEATNILQRAFTETGYNPRSFSKTKLLNIAIPIGIGYEFCLGNSSFALLGKGSIGYSRDIKRENPSTLAHLAMNDFAWTTNGCSVPTSAHTLANQLILRYKACSLYITAYTINREGKNLSNSLSCGGYVGF

SEQ ID NO: 12 - DNA, 2928 bp, Chlamydia trachomatis
atgaatcgagttatagaaatccatgctcactacgatcaaagacaactttctcaatctccaaatacaaacttcttagtacatcatccttatcttactcttattcccaagtttctactaggagctctaatcgtctatgctccttattcgtttgcagaaatggaattagctatttctggacataaacaaggtaaagatcgagatacctttaccatgatctcttcctgtcctgaaggcactaattacatcatcaatcgcaaactcatactcagtgatttctcgttactaaataaagtttcatcagggggagcctttcggaatctagcagggaaaatttccttcttaggaaaaaattcttctgcgtccattcattttaaacacattaatatcaatggttttggagccggagtcttttctgaatcctctattgaatttactgatttacgaaaacttgttgcttttggatctgaaagcacaggaggaatttttactgcgaaagaggacatctcttttaaaaacaaccaccacattgccttccgcaataatatcaccaaagggaatggtggcgttatccagctccaaggagatatgaaaggaagcgtatcctttgtagatcaacgtggagctatcatctttaccaataaccaagctgtaacttcttcatcaatgaaacatagtggtcgtggaggagcaattagcggtgacttcgcaggatccagaattctttttcttaataaccaacaaattactttcgaaggcaatagcgctgtgcatggaggtgctatctacaataagaatggccttgtcgagttcttaggaaatgcaggacctcttgcctttaaagagaacacaacaatagctaacgggggagctatatacacaagtaatttcaaagcgaatcaacaaacatcccccattctattctctcaaaatcatgcgaataagaaaggcggagcgatttacgcgcaatatgtgaacttagaacagaatcaagatactattcgctttgaaaaaaataccgctaaagaaggcggtggagccatcacctcttctcaatgctcaattactgctcataataccatcattttttccgataatgctgccggagatcttggaggaggagcaattcttctagaagggaaaaaaccttctctaaccttgattgctcatagtggtaatattgcatttagcggcaataccatgcttcatatcaccaaaaaagcttccctagatcgacacaattctatcttaatcaaagaagctccctataaaatccaacttgcagcgaacaaaaaccattctattcatttctttgatcctgtcatggcattgtcagcatcatcttcccctatacaaatcaatgctcctgagtatgaaactcccttcttctcacctaagggtatgatcgttttctcgggtgcgaatcttttagatgatgctagggaagatgttgcaaatagaacatcgatttttaaccaacccgttcatctatataatggcaccctatctatcgaaaatggagcccatctgattgtccaaagcttcaaacagaccggaggacgtatcagtttatctccaggatcctccttggctctatacacgatgaactcgttcttccatggcaacatatccagcaaagaacccctagaaattaatggtttaagctttggagtagatatctctccttctaatcttcaagcagagatccgtgccggcaacgctcctttacgattatccggatccccatctatccatgatcctgaaggattattctacgaaaatcgcgatactgcagcatcaccataccaaatggaaatcttgctcacctctgataaaattgtagatatctccaaatttactactgattctctagttacgaacaaacaatcaggattccaaggagcctggcattttagctggcagccaaatactataaacaatactaaacaaaaaatattaagagcttcttggctcccaacaggagaatatgtccttgaatccaatcgagtggggcgtgccgttcctaattccttatggagcacatttttacttttacagacagcctctcataacttaggcgatcatctatgtaataatcgatctcttattcctacttcatacttcggagttttaattggaggaactggagcagaaatgtctacccactcctcagaagaagaaagctttatatctcgtttaggagctacaggaacctctatcatacgcttaactccctccctgacactctctggaggaggctcacatatgttcggagattcgttcgttgcagacttaccagaacacatcacttcagaaggaattgttcagaatgtcggtttaacccatgtctggggaccccttactgtcaattctacattatgtgcagccttagatcacaacgcgatggtccgcatatgctccaaaaaagatcacacctatgggaaatgggatacattcggtatgcgaggaacattaggagcctcttatacattcctagaatatgatcaaactatgcgcgtattctcattcgccaacatcgaagccacaaatatcttgcaaagagcttttactgaaacaggctataacccaagaagtttttccaagacaaaacttctaaacatcgccatccccatagggattggttatgaattctgcttagggaatagctcttttgctctactaggtaagggatccatcggttactctcgagatattaaacgagaaaacccatccactcttgctcacctggctatgaatgattttgcttggactaccaatggctgttcagttccaacctctgcacacacattggcaaatcaattgattcttcgctataaagcatgttccttatacatcacggcatatactatcaaccgtgaagggaagaacctctccaatagcttatcctgcggaggctatgttggcttctaa

SEQ ID NO: 13 - protein, 1013 aa, Chlamydia trachomatis; identical to SEQ ID NO: 9

SEQ ID NO: 14 - DNA, 3042 bp, Chlamydia trachomatis; identical to SEQ ID NO: 2

SEQ ID NO: 15 - protein, 964 aa, Chlamydia trachomatis
MKKAFFFFLIGNSLSGLAREVPSRIFLMPNSVPDPTKESLSNKISLTGDTHNLTNCYLDNLRYILAILQKTPNEGAAVTITDYLSFFDTQKEGIYFAKNLTPESGGAIGYASPNSPTVEIRDTIGPVIFENNTCCRLFTWRNPYAADKIREGGALHAQNLYINHNHDVVGFMKNFSYVQGGAISTANTFVVSENQSCFLFMDNICIQTNTAGKGGAIYAGTSNSFESNNCDLFFINNACCAGGAIFSPICSLTGNRGNIVFYNNRCFKNVETASSEASDGGAIKVTTRLDVTGNRGRIFFSDNITKNYGGAIYAPVVTLVDNGPTYFINNIANNKGGAIYIDGTSNSKISADRHAIIFNENIVTNVTNANGTSTSANPPRRNAITVASSSGEILLGAGSSQNLIFYDPIEVSNAGVSVSFNKEADQTGSVVFSGATVNSADFHQRNLQTKTPAPLTLSNGFLCIEDHAQLTVNRFTQTGGVVSLGNGAVLSCYKNGTGDSASNASITLKHIGLNLSSILKSGAEIPLLWVEPTNNSNNYTADTAATFSLSDVKLSLIDDYGNSPYESTDLTHALSSQPMLSISEASDNQLQSENIDFSGLNVPHYGWQGLWTWGWAKTQDPEPASSATITDPQKANRFHRTLLLTWLPAGYVPSPKHRSPLIANTLWGNMLLATESLKNSAELTPSGHPFWGITGGGLGMMVYQDPRENHPGFHMRSSGYSAGMIAGQTHTFSLKFSQTYTKLNERYAKNNVSSKNYSCQGEMLFSLQEGFLLTKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATHRPQAWTVELAYQPVLYRQEPGIAAQLLASKGIWFGSGSPSSRHAMSYKISQQTQPLSWLTLHFQYHGFYSSSTFCNYLNGEIALRF

SEQ ID NO: 16 - DNA, 2895 bp, Chlamydia trachomatis
atgaaaaaagcgtttttctttttccttatcggaaactccctatcaggactagctagagaggttccttctagaatctttcttatgcccaactcagttccagatcctacgaaagagtcgctatcaaataaaattagtttgacaggagacactcacaatctcactaactgctatctcgataacctacgctacatactggctattctacaaaaaactcccaatgaaggagctgctgtcacaataacagattacctaagcttttttgatacacaaaaagaaggtatttattttgcaaaaaatctcacccctgaaagtggtggtgcgattggttatgcgagtcccaattctcctaccgtggagattcgtgatacaataggtcctgtaatctttgaaaataatacttgttgcagactatttacatggagaaatccttatgctgctgataaaataagagaaggcggagccattcatgctcaaaatctttacataaatcataatcatgatgtggtcggatttatgaagaacttttcttatgtccaaggaggagccattagtaccgctaatacctttgttgtgagcgagaatcagtcttgttttctctttatggacaacatctgtattcaaactaatacagcaggaaaaggtggcgctatctatgctggaacgagcaattcttttgagagtaataactgcgatctcttcttcatcaataacgcctgttgtgcaggaggagcgatcttctcccctatctgttctctaacaggaaatcgtggtaacatcgttttctataacaatcgctgctttaaaaatgtagaaacagcttcttcagaagcttctgatggaggagcaattaaagtaactactcgcctagatgttacaggcaatcgtggtaggatcttttttagtgacaatatcacaaaaaattatggcggagctatttacgctcctgtagttaccctagtggataatggccctacctactttataaacaatatcgccaataataaggggggcgctatctatatagacggaaccagtaactccaaaatttctgccgaccgccatgctattatttttaatgaaaatattgtgactaatgtaactaatgcaaatggtaccagtacgtcagctaatcctcctagaagaaatgcaataacagtagcaagctcctctggtgaaattctattaggagcagggagtagccaaaatttaattttttatgatcctattgaagttagcaatgcaggggtctctgtgtccttcaataaggaagctgatcaaacaggctctgtagtattttcaggagctactgttaattctgcagattttcatcaacgcaatttacaaacaaaaacacctgcaccccttactctcagtaatggttttctatgtatcgaagatcatgctcagcttacagtgaatcgattcacacaaactgggggtgttgtttctcttgggaatggagcagttctgagttgctataaaaatggtacaggagattctgctagcaatgcctctataacactgaagcatattggattgaatctttcttccattctgaaaagtggtgctgagattcctttattgtgggtagagcctacaaataacagcaataactatacagcagatactgcagctaccttttcattaagtgatgtaaaactctcactcattgatgactacgggaactctccttatgaatccacagatctgacccatgctctgtcatcacagcctatgctatctatttctgaagctagcgataaccagctacaatcagaaaatatagatttttcgggactaaatgtccctcattatggatggcaaggactttggacttggggctgggcaaaaactcaagatccagaaccagcatcttcagcaacaatcactgatccacaaaaagccaatagatttcatagaaccttactactaacatggcttcctgccgggtatgttcctagcccaaaacacagaagtcccctcatagctaacaccttatgggggaatatgctgcttgcaacagaaagcttaaaaaatagtgcagagctgacacctagtggtcatcctttctggggaattacaggaggaggactaggcatgatggtttaccaagatcctcgagaaaatcatcctggattccatatgcgctcttccggatactctgcggggatgatagcagggcagacacacaccttctcattgaaattcagtcagacctacaccaaactcaatgagcgttacgcaaaaaacaacgtatcttctaaaaattactcatgccaaggagaaatgctcttctcattgcaagaaggtttcttgctgactaaattagttgggctttacagctatggagaccataactgtcaccatttctatactcaaggagaaaatctaacatctcaagggacgttccgcagtcaaacgatgggaggtgctgtcttttttgatctccctatgaaaccctttggatcaacgcatatactgacagctccctttttaggtgctcttggtatttattctagcctgtctcactttactgaggtgggagcctatccgcgaagcttttctacaaagactcctttgatcaatgtcctagtccctattggagttaaaggtagctttatgaatgctacccacagacctcaagcctggactgtagaattggcataccaacccgttctgtatagacaagaaccagggatcgcagcccagctcctagccagtaagggtatttggttcggtagtggaagcccctcatcgcgtcatgccatgtcctataaaatctcacagcaaacacaacctttgagttggttaactctccatttccagtatcatggattctactcctcttcaaccttctgtaattatctcaatggggaaattgctctgcgattctag

SEQ ID NO: 17 - protein, 1013 aa, Chlamydia trachomatis
MQTSFHKFFLSMLLAYSCCSLSGGGYAAEIMIPQGIYDGETLTVSFPYTVIGDPSGTTVFSAGELTLKNLDNSLAALPLSCFGNLLGSFTVLGRGHSLTFENIRTSTNGAALSDSANSGLFTIEGFKELSFSNCNSLLAVLPAATTNNGSQTPTTTSTPSNGTIYSKTDLLLLNNEKFSFYSNLVSGDGGAIDAKSLTVQGISKLCVFQENTAQADGGACQVVTSFSAMANEAPIAFIANVAGVRGGGLAAVQDGQQGVSSSTSTEDPVVSFSRNTAVEFDGNVARVGGGIYSYGNVAFLNNGKTLFLNNVASPVYLAAEQPTNGQASNTSDNYGDGGAIFCKNGAQAAGSNNSGSVSFDGEGVVFFSSNVAAGKGGAIYAKKLSVANCGPVQFLGNIANDGGAIYLGESGELSLSADYGDIIFDGNLKRTAKENAADVNGVTVSSQAISMGSGFKITTLRAKAGHQILFNDPIEMANGNNQPAQSSEPLKINDGEGYTGDIVFANGNSTLYQNVTIEQGRIVLREKAKLSVNSLSQTGGSLYMEAGSTLDFVTPQPPQQPPAANQLITLSNLHLSLSSLLANNAVTNPPTNPPAQDSHPAIIGSTTAGSVTISGPIFFEDLDDTAYDRYDWLGSNQKIDVLKLQLGTQPSANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTKQALCGSYLFGDAFLRASYGFGNQHMKTSYTFAEESDVRWDNNCLVGEIGVGLPIVITPSKLYLNELRPFVQAEFSYADHESFTEEGDQARAFRSGHLMNLSVPVGVKFDRCSSTHPNKYSFMGAYICDAYRTISGTQTTLLSHQETWTTDAFHLARHGVIVRGSMYASLTSNIEVYGHGRYEYRDTSRGYGLSAGSKVRF

SEQ ID NO: 18 - DNA, 3042 bp, Chlamydia trachomatis; identical to SEQ ID NO: 2

SEQ ID NO: 19 - protein, 121 aa, Chlamydia trachomatis
MQLPSIIQSFFFPKAPPSPLKKPIYQQTERIINIAYLVLLSLSVVGIISGVFLSLSFPLLGAGICLISLAVGSCLLVLFPLLPDIEKIIARREPKVSITTSSPLPTLMRYFKSIGLGKAAH

SEQ ID NO: 20 - DNA, 366 bp, Chlamydia trachomatis
atgcaacttccgtctattattcagtctttcttcttccctaaagctcccccatctccacttaaaaaacctatttatcaacaaactgaacgcatcatcaatatagcttatcttgttctgttatccctatccgttgtaggaattatctctggagtattcctttcccttagcttccccctattaggcgcaggcatttgtttaatctctttagccgtaggttcctgcctacttgttttgtttccattgctcccggatattgaaaaaataattgctcgaagagaacccaaggtctcgattacaactagctccccattaccaacattaatgcgctacttcaaatcgattggccttggaaaagcagctcattag

SEQ ID NO: 21 - protein, 254 aa, Chlamydia trachomatis
MHDALQSILAIQELDIKMIRLMRVKKEHQNELAKIQALKTDIRRKVEEKEQEMEKLKDQIKGGEKRIQEISDQINKLENQQAAVKKMDEFNALTQEMTAANKERRTLEHQLSDLMDKQAGSEDLLISLKESLSSTENSSSAIEEELRENIRKINEEGRSLLSQRTQLKETTDPELFSIYERLLNNKKDRVVVPIENRVCSGCHIALTPQHENLVRKQDHLVFCEHCSRILYWQELQSPSAEGATTKRRRRRTAV

SEQ ID NO: 22 - DNA, 765 bp, Chlamydia trachomatis
atgcatgacgccctccaaagtattttggctatccaagagctcgatattaaaatgatccgtttaatgcgggtcaaaaaagaacatcagaacgagctcgctaaaattcaagctttaaaaacggatatccgtcgcaaggtggaagaaaaagaacaagaaatggagaagctgaaagatcagatcaaaggcggagaaaaacgtattcaagaaatttctgatcagatcaataaattagaaaatcagcaagctgctgtaaaaaaaatggatgagtttaatgctctaacccaagagatgaccgcagctaataaagagcgtcgcactttggagcaccaacttagcgatcttatggataagcaagctggtagcgaagatcttcttatctctctgaaagaaagtctctcttctacggaaaatagtagcagtgctatcgaagaagaaattcgagagaatattcgaaaaattaatgaagaaggtcgttctttactaagtcagagaacacagctgaaagaaacgacagatccagaattatttagcatctacgagcgcttgctcaacaacaagaaagaccgagttgttgtccctatcgaaaatcgtgtttgcagtggctgtcatatagctcttaccccgcaacatgagaatttggtacgtaaacaagatcatcttgtattttgtgaacactgctcaagaattctttactggcaagagttgcaatctccatcagcagaaggcgcaactacaaaacgtcgtcgtcgtcgtactgcagtataa

SEQ ID NO: 23 - protein, 878 aa, Chlamydia trachomatis
MRPDHMNFCCLCAAILSSTAVLFGQDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSLLAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLLMEAGTSLKTSSDLKLATLSIPLHSLDTEKSVTLHAPNLSIQKIFLSNSGDENFYENVELLSKEQNNIPLLTLSKEQSHLHLPDGNLSSHFGYQGDWTFSWKDSDEGHSLIANWTPKNYVPHPERQSTLVANTLWNTYSDMQAVQSMINTIAHGGAYLFGTWGSAVSNLFYAHDSSGKPIDNWHHRSLGYLFGISTHSLDDHSFCLAAGQLLGKSSDSFITSTETTSYIATVQAQLATPLMKISAQACYNESIHELKTKYRSFSKEGFGSWHSVAVSGEVCASIPIVSNGSGLFSSFSIFSKLQGFSGTQDGFEESSGEIRSFSASSFRNISLPMGITFEKKSQKTRNYYYFLGAYIQDLKRDVESGPVVLLKNAVSWDAPMANLDSRAYMFRLTNQRALHRLQTLLNVSYVLRGQSHSYSLDLGTTYRF

SEQ ID NO: 24 - DNA, 2637 bp, Chlamydia trachomatis; identical to SEQ ID NO: 8

SEQ ID NO: 25 - protein, 697 aa, Chlamydia trachomatis
MKRFFPLFIGVLLAHTLPSEGLSHQQAVQKKISYLSHFKGITGIMDVEDGVLHIHDDLRLQANKAYVENRTDCGIKIVAHGNVMVNYRGKILICDYLEYYEDTDSCLLTNGRCSLYPWFIGGSTITISPSSIIIHKGYISTSEGPQKHICLSGDYLKYSSDSVLSMGPSRLSICNTPVLLLPQISIMPMEIPKPPITFRGGSGGFLGSYLGVSYSPISKKHCSTTLFLDGFFKHGIGLGYNMRFSSQENPSNAINIKSYYAHRLAIDSSGAKDRYRLHGDFTFSKERAHLAGEFHLSDSWETVVDIFPNNFSLKNTGPTEVSLSWRDNNLFGKMTSSVKVNSFQNVKQELPQAILHHRPVRIRRSRIFLENRLEAGFLDFHFSSNIPGSNFSSWRFSSAHKVYRGLVLPIGTLTPSLSGTAIYYTRMLSPNAAHCQLSGSLSFDYRVALQKEYRHARHIVEPFCSFLKTTRPVLSSDEPHIFSIKDAFHSINLLHVGLESKVLNKHSTPSHLKLWTTYIFDEPHAKDTFPKTACWFSLPLTLQNTLSLDAEWIWKKSRWDHLNVIWEWILNDNLGLTLEFLHRSKYGFIKCAKDNYTLDVSRSLDTLLASPLSDRRNLITGKLFVRPHPHWNYNLNLRYGWHRPDSPSYLEYQMILGHKIFEHWQLFSVYEKREADKRCFFYLKLDKRKQKHRHPFG

SEQ ID NO: 26 - DNA, 2094 bp, Chlamydia trachomatis
gtgaaacgatttttcccactttttattggagtgctgctcgcgcacactttgccgtcagaaggtctttctcatcaacaagctgtccaaaaaaaaatttcttatctgagccattttaaaggcattacaggaattatggatgttgaggatggggtattacatatccatgatgatctacgtcttcaagccaataaagcctatgttgaaaatcgcacggattgtgggatcaaaatcgttgctcatggcaacgttatggtcaattatcgcgggaaaattttaatctgtgattatcttgagtactatgaagatacagattcttgtttactcaccaatggccgctgttcgttatacccatggttcattggaggatccactataacgatctcaccatcttctattatcattcataaagggtatatctcgacttctgaaggtcctcagaaacatatttgtttatccggagattatttaaaatactcttcagacagcgtattatctatgggaccctcacgtctttctatctgtaatacgcctgtgttattgcttcctcaaatctccattatgcctatggagattcctaagcctccgattacttttcgaggtgggagtggaggatttctgggatcctacttaggtgttagttattcccctatatctaaaaagcattgttctacgactttgttcttggatggtttttttaaacatggaataggtctcggctataacatgcgcttttcctctcaggaaaatccaagcaatgccataaatattaaaagctattacgcacatcgattagctattgattcatcaggagcaaaagatcgctatcgattacatggagacttcactttttccaaagaacgagcccatcttgctggtgaattccatttaagtgatagctgggaaacagttgtggatatcttcccaaataacttctctttaaaaaatacaggccctacagaagttagcctatcatggcgcgataacaatttatttgggaaaatgacttcctctgtcaaagtcaactcctttcaaaatgttaaacaagaattgcctcaagcaattcttcatcaccgaccagtacgtatcaggcgctctcgcattttcctagagaatcgcttagaagctggttttttagattttcatttcagtagtaatattccaggctctaacttctcatcatggaggttctcatccgctcacaaagtctaccgtgggcttgttcttcctataggaacgttaaccccttcgctatctggaactgctatctactatacccgcatgctctccccaaatgcagcccattgtcaattatctggatcgctatcttttgattatcgcgttgctttacaaaaagaatatcggcatgcaagacatattgtagagcctttttgctcctttttaaaaaccactcgtcctgtattatcctctgatgagcctcatattttctcgattaaagatgcttttcactctatcaaccttctacatgtaggattggagtcaaaagtcttaaacaaacattccactccttcgcatctgaaactatggacgacctatatctttgatgaacctcacgctaaggacactttccctaaaactgcttgctggttctctcttcctcttacactccaaaatactttatccttagatgcggaatggatttggaaaaaaagccgatgggatcatctcaatgtaatctgggaatggattttgaatgataatctcggtcttactttagaatttttacatagaagtaagtatggctttattaagtgcgctaaagataactacacactcgatgtaagccgatctttagacacattactagcctctcctctttccgatcgaagaaatttgattactggcaaactttttgttcgtccacatcctcattggaattataatcttaatcttcgttatggatggcatcgtccagactctccatcctatttagaataccagatgattctgggtcataaaatctttgagcactggcagctattctctgtctacgaaaaacgtgaagctgataagcgctgcttcttttatctaaaattagataaacgaaaacagaaacaccgccatccttttggataa

SEQ ID NO: 27 - protein, 566 aa, Chlamydia trachomatis
MGLSRLAFISFLSFTLSASCDFPSSVSQRILFSCRKSVPQALEAYLEASATYQQHDFSVLRVIAESYLQQSFLSEDTYIRKSAIIGAGLSGSSEALELLSEAIETQDLYEQLLILNAATSQLSKTSDKLLFKGLTASHPVIRLEAAYRLACMKNSKVSDYLYSFIYKLPEEIQNLAATIFLQLETEEADAYIHHLLSSPNNLTRNYVAYLIGEYKQKRFLPTLRSLLTSASPLDQEGALYALGKLEDSGSYPRIKALSSRSNPEVVLAAAQTLLFLEKEEEALPILTNLCQQKLLRALYTARFLSQEKGEELLLPIFYNATQEEIRLNTALALVHQGCTDPQVLHYLTEILESKVLHRIFLPTHSTGKAIQFWKECTTFPLMSQEDKMRTLAMYRVAEDTILSALLKLPNDAYLPYLERILASQKTILAAKAIAFLSVTAHPQALSLVSKAALTPGDPIIRAYANLALYTMTKDPEKKAVLYRYAEQLIEDTILFTDAENPLPSPSSSYLRYQVSPETRTQLMLAILETLVSSKTDEDIRVFLSLMKKTHYKNIPILSGLLMRIVE

SEQ ID NO: 28 - DNA, 1701 bp, Chlamydia trachomatis
atgggactatctcgtctagccttcattagtttcctctcttttacactctcagccagctgtgattttccttcctcagtttctcagagaatcttgttttcttgccgaaaatcagtccctcaagctctagaagcctatctcgaagcttcagcaacttatcaacaacacgatttctccgtattacgcgtaatagcagaatcgtatttacaacaaagctttctctctgaggacacctacatacgtaaaagtgcaattattggagcagggctatctggttcatcagaagctttagagttactgtctgaggctatagaaacgcaagatctctatgagcaactactcattttaaatgctgcaaccagccaattaagcaaaacttctgacaaacttttattcaagggattaacagcttctcatcctgtcatccgcttagaagctgcttatcgtcttgcctgtatgaaaaatagcaaggtaagtgattacctttattcttttatctacaagttaccagaagaaattcaaaacctagcggcaactattttcttacaactcgaaacagaagaagctgatgcttatattcatcatttgctctcttctcccaataacctgacaagaaactatgttgcctatttaattggagagtacaaacaaaaaagatttcttccaacactacgctctttacttacaagtgcctctcctttagatcaagaaggcgctttgtatgcgttaggcaaactggaagactctggtagctatcctagaattaaagctctaagctctagatccaatcctgaagtagtactcgctgcagctcagacattattattcttagagaaagaagaagaagctctaccgatcctaaccaacctttgccaacaaaaacttcttcgagccctgtataccgcacgtttcctctcgcaagagaagggtgaagagcttcttcttccaatcttttataacgcaacacaagaagaaattagactgaatactgctttagcacttgttcatcaagggtgtacagatcctcaagtcctccactatctaacagaaatcttagaaagtaaagttctccatcgcatatttttacctactcactcgacaggaaaagctatacagttctggaaagaatgcaccacttttcctctcatgagccaagaagacaaaatgagaacgttggctatgtatcgggtagcggaagataccatcctctcagcgttactaaaattacccaatgacgcctatcttccttacctagagcgcatcctcgcctcacaaaaaactatactagcagctaaagctattgcttttttatcggtaacagctcatcctcaggcactttctttagtctcgaaagctgcattaactcctggagaccctatcattcgcgcttacgctaatctagctttatatacaatgaccaaagatcctgagaaaaaagctgtgctataccgatatgctgaacaattaatagaggataccattttattcacagatgctgaaaatccgcttccctctccaagctcttcttatttacgctaccaagtatcccctgagacccgcacacaacttatgctagctattttggaaaccttagtttcttccaaaacggatgaagatatccgcgtttttctttccctaatgaaaaaaacccattacaaaaatatcccgatcttatcaggattgttaatgagaatagtggagtga

SEQ ID NO: 29 - protein, 233 aa, Chlamydia trachomatis
MREEAMKKQGVLVAPSIMGADLACIGREARNIEESGADLIHIDVMDGHFVPNITFGPGVVAAINRSTELFLEVHAMIYTPFEFVEAFVKAGADRIIVHFEAAENIKEIISYIQKCGVQAGVAFSPETSIEFVTSFIPLCDVILLMSVHPGFCGQKFIPDTIERIQFVKQAIQVLGREGSCLIEVDGGIDKESARACREAGADILVAASYFFEKDSINMKEKVLLLQGEEHGAK

SEQ ID NO: 30 - DNA, 702 bp, Chlamydia trachomatis
atgagagaagaggccatgaaaaaacaaggggtgttggtagctccatctattatgggagctgacttagcttgcataggaagagaagcgcgaaatatagaagagtccggagcagatcttattcatatagacgttatggatggacattttgttcccaatattacttttggtcccggagttgttgctgcgattaatcggtcaacagagctatttctggaagttcatgctatgatttatacgccttttgaatttgtagaggcttttgttaaggccggggcggatcgtatcattgtgcattttgaggcagcggaaaatattaaagaaattattagctatattcaaaaatgcggagtgcaagcaggggtagctttctctccagagacttctatagagtttgtcacatctttcatacctctatgcgatgtcatcttgcttatgtctgtgcatcctggtttttgtgggcaaaagttcattcctgatacgatagaaagaattcaattcgttaaacaagctatacaagtcctaggaagagaaggaagttgcttgattgaagttgacggtggtattgataaagagtctgcacgagcatgtagggaagcaggcgcagatattttggttgcagcctcctatttttttgagaaagactctataaatatgaaagaaaaagttttgttacttcaaggggaagaacatggtgctaagtag

SEQ ID NO: 31 - protein, 264 aa, Chlamydia trachomatis
MFVGITYYTTPLLEIALIWVVLNYLLKFFWGTGAMDLVFGLLSFLCLFVLAEKLHLPVIRNLMLHVVNLAAIVVFIIFQPEIRLALSRIRLRRGKFVINMQDEFIDHLTACIYRMAERQIGALIVLENERLLNDLLNLSAVKINADFSEELLEAIFEPSSHLHDGAVLMRGETISYARVILPLAHDTTQLSRSMGTRHRAALGASQRTDALVIVVSEKTGAVSLARDGILTRGVKMDRFKAILRSILTRNERKTNPIISWMRKK

SEQ ID NO: 32 - DNA, 795 bp, Chlamydia trachomatis
atgttcgtaggtataacgtattacaccacacctctgttggagatagctttaatttgggtggtccttaattatttgctaaagtttttctggggaacaggcgccatggacctcgtctttggcttgttgtcttttctttgcctatttgttctagcagaaaaacttcatctccccgttattcgcaatttgatgcttcatgtagtgaatattgcggctatcgtggtatttattatcttccaaccagaaattcgccttgctctctctaggatacgcttgcgtagagggaaatttgtcatcaatatgcaagacgaattcattgaccatttgacagcatgcatctatcgcatggctgaacgacaaatcggagctctcattgtattagaaaatgagcgtcttttgaatgatctgcttaatctctctgccgtgaaaattaatgcagatttttcagaagaacttctcgaagctatttttgagccctcctcccatctacatgatggagccgtgttaatgagaggcgagactatctcttacgctagagtaattcttcctcttgctcatgataccacacaactgtcgcgatccatgggaacgcgtcatcgtgcagcactcggtgctagtcagcgtaccgatgctctcgtgattgtagtatcagaaaagaccggtgcagtttccttagctcgtgatggaattttaactcgtggagtaaagatggatagatttaaagccatcctgcgaagtatcctaacgcgcaatgaacgaaaaacaaaccctattatctcctggatgcgtaaaaaatga

SEQ ID NO: 33 - protein, 628 aa, Chlamydia trachomatis
MTSSYMSRLYSLNKSRRILHSSFRLLKSTKMLSHPETQKELQEVLKQLEEAILDQNREDASLFAKQAQAIQKRFPKSKLRATFDLIYALTFAALLAFLIRQFWFELYEVPTGSMRPTILEQDRILVSKTTFGLRLPFSNKSIGYTPEAITRGELVVFTVGDLPIPSADTKYFGIIPGKKRYIKRCMGKPGDTVYFYGGKIYGIDCDGEPIFPQNTENLYHVPYISFDGTPEILTHSEEQTDVIFNQFHTPCGKISLPQQASYGQFFYKNAWHNDTPYALKDPHNEPVSYADLFGIKNFAMVRILTKKQAALTHVLPSPLSDTYLEIAHTPNVSYPHPHLRPFETQLIPTIEPMKTLLPLRKEHIHLIRNNLTTSRFTVVDGYAYKYQPAPMNTSGMARMFALPMPNIPDGCYEFSKGDVFKINMSGFRTKLKQPHPLTQLSNSQVIDLFNCGISFHTIYIPKNPQYAPFPNRYAFFHQGNLFVMDSPVFIDSDPALQKFIVSEEEKELQSSEDKPYIAFIDRGPPPESTEEFVSFITNFGLKIPEGHVLVLGDNCPMSADSRDFGFVPVENLLGSPVGIFWPINRLGLLSSNITPLSLPGYLVNGLALGAFLYCIGLWYYRKNHRLFP

SEQ ID NO: 34 - DNA, 1887 bp, Chlamydia trachomatis
atgacgagcagttacatgagtcgcttatattccctgaataagagtcgtcgcattcttcattcttcctttagattgctgaaaagcacaaaaatgctctctcatccggaaactcaaaaagaactacaagaagtcttgaaacagcttgaagaggctattttggatcagaatagggaagatgcttccctttttgctaagcaagctcaagccatacaaaaaagattccctaaatccaaactccgagctacttttgatcttatctatgctttgacgtttgctgccattcttgcttttttaatccgccagttctggtttgagctatatgaagttcctacaggatctatgcggcctactattcttgaacaagatcgtattcttgtttccaaaacaacatttggactccggctaccttttagtaacaaaagtattggctatacacctgaggctatcactcgaggagaactggtagtcttcactgttggagatcttcctatccctagcgccgacactaagtattttggaatcatccctgggaaaaaacgctatataaaacggtgcatgggtaaacctggagataccgtatatttttatggagggaaaatttatgggatcgattgcgacggagagcccatcttcccccaaaatacagagaatctctaccacgtcccctatatttcttttgacggaactccagaaatccttacccattcagaagagcaaacagatgtgatctttaaccaatttcacacaccttgtggaaagatttctctccctcaacaggcttcttatggacaatttttctataagaatgcttggcataatgatactccctatgctttaaaagatcctcataatgagcctgttagctatgccgatctattcggaataaaaaattttgcaatggttcgcatccttaccaaaaaacaagctgctcttactcatgtccttccctctcctctttcggacacctacctagaaattgcccacactcctaatgtttcctatcctcaccctcacttacgtccatttgaaacacagcttattcctactatcgaacctatgaaaaccttgcttcctttaaggaaggaacatattcatttgattcgtaataacctcacaacatcccgttttacagttgtagatggatatgcttacaagtaccaacctgctcccatgaatacctcaggcatggccaggatgtttgccctacctatgccaaatattcctgacggatgttatgaattttctaaaggagacgtgtttaaaattaatatgagtggctttcgaacgaaactcaaacagccgcatcctttaacgcaattaagcaattctcaggtcattgacttatttaattgcggcattagtttccacacgatctatattcctaaaaaccctcaatatgctccgttccctaatcgctatgcatttttccatcaagggaacctgttcgttatggattctccagtttttattgatagcgatcctgccttacagaaattcattgtgtctgaagaggaaaaagaacttcaatcatctgaagacaaaccttacatcgcgtttattgacagaggtcctcctccagaatctacagaggaatttgtttcctttattactaatttcggtcttaaaattccggaaggccacgtgcttgtcttaggagataattgtcctatgagcgctgatagccgtgattttggttttgttcccgttgaaaatcttttgggatctcctgttgggatcttctggcctattaatcgtctaggattgttatcttccaatataacgcccttgagtttacctggctacctcgtaaatggattggctctaggagcttttctttactgcataggattatggtactatcgaaaaaaccataggctattcccttaa

SEQ ID NO: 35 - protein, 262 aa, Chlamydia trachomatis
MFKLIKSAFLIACCIVGYFWIKKESIVEQWLSQQLHAQVTVGNISPGLSKTKIRHLCIHNPLSSDKYPYAVEIEYVSLKYSIVTMILSKKIDISDVILQGTSLTVFPCEGSSKTNWSFFWDSFINHSNELTKFHSSQFESSVDTIPVFIKRCLCTNTRVSGIKNNYKEIPTTPVPSLEFRGSLSCSPLPTLGETARALLYLLVEESFYHANVSGDIARPLSKQARAYFNSSLSDYSYLKKRGTFPSNLTNELEGFMKELLFR

SEQ ID NO: 36 - DNA, 789 bp, Chlamydia trachomatis
atgtttaaactaatcaagagcgcatttctcatagcctgttgtattgtagggtacttctggataaaaaaagaaagtattgttgagcagtggctatcccaacagttgcatgctcaagtgaccgttggcaatatttcccccggtctttccaaaacgaagattcgccatttatgtatccacaatcctctttcttccgataagtatccctatgcggtagaaattgagtacgtgagtctcaagtactctattgttaccatgattctttcgaaaaagatcgatatttctgatgtaatcctacaaggaacatctctaactgtattcccctgcgaaggatcttctaagacaaactggtcattcttttgggatagctttatcaatcattctaatgagctgaccaagtttcattcttcacagtttgagtcatctgttgatacaatccccgtattcattaaacgttgtctatgtacaaacacgagagtcagtggcatcaaaaacaactataaggaaatccctactacacctgtgccgtctctcgaatttagagggtctttatcttgttctcctctaccaactttaggagaaactgcgagagccttactgtatctcatcgtggaagagagtttttatcacgcaaatgtttcgggagatatcgctcgtcctctttctaaacaggctcgagcatacttcaattcttctctatccgattactcttatctaaaaaaacgaggaacatttccttcgaatcttaccaatgaacttgagggttttatgaaagagttgctattccgatag

SEQ ID NO: 37 - protein, 251 aa, Chlamydia trachomatis
MNVSDLLNILNELLHPEYFSDYGPNGLQVGNAQTAIRKVAVAVTADLATIEKAIACEANVLLVHHGIFWKGMPYSITGILYQRMQRLMEGNIQLIAYHLPLDAHTTIGNNWKVARDLGWEQLESFGSSQPSLGVKGVFPEMEVHDFISQLSAYYQTPVLAKALGGKKRVSSAALISGGAYREISEAKNQQVDCFITGNFDEPAWSLAHELAIHFLAFGHTATEKVGPKALAQYLKGAGLESVVFLDTDNPF

SEQ ID NO: 38 - DNA, 756 bp, Chlamydia trachomatis
atgaacgtttcagaccttctcaatattttgaatgaactgttacatcctgaatattttagtgactatggccctaatggtttacaagttggtaatgcacaaactgcgattcgtaaggtggcggttgcagtcacagcggatttagcaactattgagaaggcaatagcttgcgaagccaatgttttgcttgtacatcacgggatattttggaaggggatgccctattccatcacagggatactctatcagcgtatgcaacgcttgatggaagggaatattcagttgatagcttatcatttaccgttagacgcgcatacaacgattggtaataactggaaagtagcaagggatctaggttgggaacaactagaatctttcggaagctctcagccttctttaggagttaagggagtcttcccagaaatggaggttcatgatttcatatctcaattatctgcatactatcaaacaccggtattagcgaaagctcttggaggaaagaaaagagtttcttctgcagcgcttatttctggcggggcttatcgtgaaatttccgaagctaaaaaccagcaggtagactgcttcatcactggtaattttgatgagccggcatggtctttagcgcatgagctggctattcattttttggcttttggacatacagctactgaaaaagttggtccaaaagccttggctcaatatttaaaaggagcgggtttagaatcagttgtgtttttggatacggacaaccctttttaa

SEQ ID NO: 39 - protein, 315 aa, Chlamydia trachomatis
MKKFATFLCVLLSGSGFAAPVEVPGFPSIPETYITINDKELGLQEHCRGVNVLSCGYNLVGMFHTPTTPMPLGGYPTVIFFHGFRGNCTGKDGVYRDLARLLTANGIAVARFDMAGCGNSEGICDQIPARTYLRNGEDLLATVAKYPEVNPHRIGIAGISLGCHTTIHLASTYRPRDYTVQAISVWAPIADGVILLKEICATIGLTMTQFSDMGEVGKAFGFKQLPLKLCRDDIDFFLGIQDHILLLSLPRRIPVLHQQGLEDHVVSTAHQRLFLGAAPAQMLSKSYPETPHEIASSPYRQEVLQEILTHFQSNL

SEQ ID NO: 40 - DNA, 948 bp, Chlamydia trachomatis
atgaaaaagtttgctactttcctgtgtgtactcttatctggaagtggttttgcagctcctgttgaagtgcctgggtttccctctattcctgaaacctacattactatcaatgataaggaattaggtcttcaagagcattgccgtggtgttaatgttctcagctgcggatataatttagttggtatgttccataccccaaccactcctatgcctctaggaggatatcctactgtaatctttttccatggattccgcggaaattgtacaggaaaggatggggtctatcgagacttagcccgccttcttacggcaaatggaatcgctgtagccagattcgatatggctggctgtggaaatagcgaaggaatatgtgatcaaatccctgcacgaacctacctgcgcaacggcgaagatatcttagccaccgtagctaaatacccagaagtcaaccctcaccgcattggtattgcaggaatttccttaggttgtcacactaccattcatctggctagcacctatagacctagagactatacggttcaagccatctccgtctgggctcctattgctgacggagtcatccttctcaaagagatctgtgctactattggcctaaccatgacccagttttcggatatgggtgaagtgggtaaagcatttggattcaaacaacttcccctcaagctgtgtcgagatgatatcgatttcttcttaggtattcaggatcacatcctcctgctatccttaccaagaagaatccccgttctccaccaacaaggactagaagatcacgtagtttctacggctcaccaacgcctatttttaggggctgctccagcgcaaatgctgtctaagagttaccccgaaactccccatgaaatcgcttcatctccttatcgccaagaggttttgcaggaaatcttaacgcatttccaatcaaatctttaa

SEQ ID NO: 41 - protein, 163 aa, Chlamydia trachomatis
MRFLLALFSLILVLPATEAFSTEDKQCQQEAEEDCSQVADTCVFYSYAEGLEHARDEGKLTLVVLLDTSGYSFETLADAAHAMESSLLSTFADFVVLSRREAVPLIYPPVPDPMVGEIALFLEAFSDQTFPSQPVIVTLAIGASSAEIMDITEIPSINPEFVE

SEQ ID NO: 42 - DNA, 492 bp, Chlamydia trachomatis
atgagattcttgttagctttattctcactgatactagttcttcctgcgactgaggcattctcaacagaggataagcagtgtcaacaagaagcagaggaagactgtagtcaggtagcggacacctgcgtattttatagctatgcagagggtttagaacacgcaagggacgaagggaaactcaccttagtagtattgttagatacttctgggtattccttcgagactcttgctgatgcagcccatgctatggaaagttcgttgctatccacatttgctgattttgtggttctttctaggagggaagcagttccactgatttatcctccggttccagatcctatggttggcgagatagcgttgttcttagaagctttctcagatcaaacatttccatcacagcctgtgattgttaccttagctattggggcttcttctgcagagatcatggatattaccgagattccgtcaataaatcctgaatttgttgagtag

SEQ ID NO: 43 - protein, 518 aa, Chlamydia trachomatis
MRKISVGICLLLALATSGCSKSSSNATHRSPATHTVAVSVKDDPRTFDPREVRLLSDINLIHHLYEGLVQETPSGEVFPALAESFFLSEDKKTYTFNLKKAFWSNGDLITAHDFVRSWNDVLQNRVASIYSFAFLPIDVNKDSGFFAKDDHTLVINLLTPTPHFLKLLTLPVFYPVHSQHQIRKEEKSLPISTGAFFLKEKKDRRWLKLEKSPYYYNKDQVAVQEICIHIIPDQQTASALFNQGKLDWQGLPWGHSIPQETLATTNKRRAPRSFDISGTSWLTFNTAKKPFSHSKLRQALSLVLNKEALASLAFVKPAKHLLPAHLHTYPEQPSYKQQEAITLAKSLLEEALTELNMTIEDLEKYPLTFSATSTMNSQIAQMLRDQWRRSLGITFPICGKEYALLQNDLIGNTFFMSIGGWFADFSDPLAFLSIFSSKGVKPYALQDPQFDQLILSIETEKNPQKRSALISEASLYIERQNVIEPLYHDVFHYTTNNKLSFVRLHPSGLVDMRYAKNS

SEQ ID NO: 44 - DNA, 1557 bp, Chlamydia trachomatis
atgcgcaagatatcagtgggaatctgcttgctcctagcattagcaacttctggatgttcaaaatcctcctctaacgcaacccatcggtctccagctactcacacagttgctgtaagcgtaaaagatgatcctcgcacatttgatcctcgagaggttcgccttctttctgatatcaatttgattcatcatctctatgaaggattggtacaagaaactccttctggagaagtcttccctgctttagcggagagtttcttcttatccgaagataaaaaaacttatactttcaacttgaaaaaagctttttggagcaatggagatcttattaccgctcatgattttgttcgttcctggaatgatgtgttacaaaatcgtgtcgctagtatttattctttcgcctttctccctattgacgtgaataaggattctggattttttgccaaagatgatcatactcttgttatcaatctcctcactccaactccacattttctaaagctgcttaccctccccgtattttatcctgtgcattcgcagcatcagatacggaaagaagaaaaatctcttccgatatctactggagcttttttcttaaaagagaagaaagaccgaagatggttaaagctagagaagagcccttactactataataaagaccaggtagctgtacaggagatctgtatacacatcattcctgatcaacaaactgcttctgctttattcaaccaagggaagctagattggcaaggtctcccttggggacatagtattccgcaagaaactttagccacaacaaacaaacgacgagctccccgatcatttgatatatctggtacttcctggcttacatttaacactgccaaaaagccttttagtcattccaagcttcgccaagctttgagtctagttttaaacaaagaagctcttgcctccttggcttttgttaaacctgcaaaacatctccttcctgcacatttgcacacctacccagagcagccttcttataagcaacaagaggccatcactttagctaaatctttactagaagaagctctgactgagcttaacatgactattgaggatctagagaagtatcctcttaccttttccgcaacgtctactatgaactcacagatagctcagatgttgcgcgatcagtggcgaagaagtttaggaattactttccctatctgcgggaaagaatatgctttgttgcaaaacgatctaataggcaatactttctttatgtctataggtggctggtttgccgacttttctgaccctttagcgtttctttccattttctcctcgaaaggagtcaaaccttatgctttacaagatcctcaatttgatcaactgattctctctatagaaacggaaaaaaaccctcaaaaacgctcagctttaatttccgaagcttctctatacatagaaagacaaaacgtcatagaacccctctatcacgacgtgttccattatacaacaaataataaactttcttttgttagactacatccttcgggcctagttgatatgcggtatgctaaaaactcttaa

SEQ ID NO: 45 - protein, 518 aa, Chlamydia trachomatis; identical to SEQ ID NO: 43

SEQ ID NO: 46 - DNA, 1557 bp, Chlamydia trachomatis; identical to SEQ ID NO: 44

SEQ ID NO: 47 - protein, 426 aa, Chlamydia trachomatis
MYVRSIFFSIIAFLTVGCSFSPPESGLIIAIHDDPRSLSPEKGENAFHFSLSKALFATLFREELSGLTPALVSSYQVSEDGRFYRFCIRKDAKWSDGSLLLAEDVLAAWEHTKQAGRYSLLFEKLSFRASSSSEILIELKEPEPQLLALLASPFFAVYRPENPFLSSGPFMPKTYVQGQTLVLQKNPYYYDHAHVELHSIDFRIIPNIYTALHLLRRGDVDWVGQPWHQGIPFELRTTSALYTHYSVDGTFWLILNPKDPVLSSLSNRQRLLAAVQKEKLVKQALGTQYRVAESSPSPEGIIAHQEASTPFPGKITLIYPNNITRCQRLAEVLQEQCRDAGIQLTLEGLEYHVFVQKRATQDFSVSTATSIAFHPLAKSKFDQTALDNFTCLPLYHIEYDYILSRPLDQIVHYPSGSVDLTYAHFH

SEQ ID NO: 48 - DNA, 1281 bp, Chlamydia trachomatis
atgtatgttcgctctatcttttttagtattatcgccttcctaacggtcggatgctccttttctcctccagaatcgggcttaatcatagccattcacgatgatcctcgctctctttctccagaaaaaggagaaaatgctttccatttttctttgtccaaggctttatttgctactctcttcagagaagagctctctggattaacccctgctctggtctcctcctatcaagtttcggaagacgggcggttttatcgtttttgtattcgtaaagatgctaagtggagtgacggctctcttttacttgcagaagatgtaatagctgcttgggaacacactaaacaagctgggcgatattccctactttttgaaaagctatcttttcgagcctcttcttcttcagaaatccttattgaactcaaagaacccgagcctcaactattggcgatattagcctctccgttttttgctgtgtatcgtccagaaaatccttttctttcttctggaccttttatgccaaaaacctatgtgcaagggcaaacgctcgttctacaaaaaaacccttattactatgaccatgcgcatgtggaattacattccatagactttcgcatcattcccaacatttacacagctctacacctcttaagaagaggtgacgtggattgggtggggcagccttggcaccaagggattccttttgagcttcggactacctctgctctctacacccattactctgtagatggcacattctggcttattcttaatcccaaagatcctgtactttcctctctatctaatcgtcagcgattgattgctgccgtccaaaaggaaaaactggtgaagcaagctttaggaacacaatatcgagtagctgaaagctctccatctccagagggaatcatagctcatcaagaagcttctactccttttcctgggaaaattactttgatatatcccaataatattacgcgctgtcagcgtttggccgaggtattgcaagaacaatgccgagacgcaggtatccagctgactcttgaaggactcgaataccatgtatttgttcaaaaacgagccactcaagatttctctgtctccacagcaacttctatagctttccatccccttgctaaatctaagttcgatcaaacggctctagacaatttcacttgtctgcccttgtaccacatagaatatgattatattttgagcagaccgctagatcaaattgttcactatccttcaggtagtgttgatttgacctatgcacactttcactag

SEQ ID NO: 49 - protein, 529 aa, Chlamydia trachomatis
MHHRKFLAVSIAFVSLAFGLTSCYHKKEEPKDVLRIAICHDPMSLDPRQVFLSKDVSIVKALYEGLVREKEAAFQLALAERYHQSDDGCVYTFFLKNTFWSNGDVVTAYDFEESIKQIYFREIDNPSLRSLALIKNSHAVLTGALPVEDLGVRALNAKTLEIVLENPFPYFLEILAHPVFYPVHTSLREYYKDKRNKRVFPIISNGPFAIQCYEPQRYLLINKNPLYHAKHDVLLNSVCLQIVPDIHTAMQLFQKNHIDLVGLPWSSSFSLEEQRNLPREKLFDYPVLSCSVLFCNIHQTPLNNPSLRTALSLAINRETLLKLAGKGCSATSFVHPQLSQIPATTLSQDERIALAKGYLTEALKTLSQEDLEKITLIYPIESVCLRAVVQEIRQQLFDVLGFKISTLGLEYHCFLDKRSRGEFSLATGNWIADYHQASAFLSVLGNGTRYKDFQLINWQNQKYTNIVAQLLIQESSDLQLMAEQLLLKESPLIPLYHLDYVYAKQPRVSDLQTSSRGEIDLKRVSLAEG

SEQ ID NO: 50 - DNA, 1590 bp, Chlamydia trachomatis
atgcatcacaggaagtttttagcagtttccattgctttcgtaagtttagcttttgggctaacatcttgttatcataaaaaagaagaaccaaaagatgttttgcggattgcgatctgtcatgatccaatgtctttagatccgcgtcaggtttttttaagcaaagatgtttctattgtaaaagctctctatgaagggttagtccgggaaaaagaagctgcgttccagctagctttggcagaaagatatcatcaatctgatgatggttgtgtttatactttttttctaaaaaatacattctggagcaacggagatgttgtaacagcatatgattttgaagagtctattaaacaaatttatttccgagaaattgataacccttcgttacgctctcttgcattaattaaaaattctcatgctgttttaacaggagctctccctgttgaagatttaggtgttagagctttgaatgcgaaaactctagaaattgttttagaaaacccgtttccttattttctagagatattggcgcacccggttttttatccggtgcacacctctttacgagaatattacaaagataagcgtaacaaacgcgttttcccgataatttctaatggtccttttgcgattcaatgttatgagccgcaaagatatttactaatcaacaaaaaccctctgtatcatgccaagcacgatgttctgttaaattcggtatgtttgcagatagttcctgatatccatacagctatgcagttattccaaaaaaatcatatcgatttagttgggttaccctggagctcctccttttctttagaagaacaaagaaatctccctagagaaaaattatttgattatcctgtattgagttgctctgttttattctgtaacattcatcaaacacctttaaataatccctcgctgagaacagccctctctttagcaatcaatcgagaaactttattaaaactagcaggtaaaggctgtagcgctacgagctttgttcacccacaattatctcagatacctgctactactttgtctcaagatgagcggattgctttagcaaaaggctacttgaccgaagctttaaagactttatctcaagaagatttagaaaaaattacattaatttatcctatagaatctgtttgcttacgagccgttgttcaagaaattcgccaacaattatttgatgtactgggatttaaaatttctacattaggattagaatatcattgttttttagacaaacgttccagaggagaattctccttagcaactggtaattggattgcagactatcatcaagctagtgctttcctgtctgtcctaggtaatgggacaagatataaagactttcaattgattaactggcagaaccaaaagtacacaaatatagttgctcaacttctgattcaagaatcaagcgacctacagcttatggcagagcagttgttgcttaaagaaagtcctcttattcctctataccacctcgattatgtgtatgcgaaacagcctcgggtgtctgatctccaaacctcttctcgtggagaaattgatttaaaaagagtttcattagctgaaggatag

SEQ ID NO: 51 - protein, 283 aa, Chlamydia trachomatis
MPHQVLLSPVCDLLSNAEGIETQVLFGERICNHNHRHYAYSQLVFSSIWKPYPGDSLQNIPLFSSQLQPPNAVVCSQEAFLDPWHIPLPFAAPLHIDNQNQVSLSPASIALLNSNSRSNYAKAFCSTKEIRFLNSSFSPRDLVSFAEQLIDTPYVWGGRCIHKQLPRNGVDCSGYIQLLYQVTGRNIPRNARDQYRDCSPVKDFSSLPIGGLIFLKKASTGQINHVMMKISEHEFLHAAEKIGKVEKVILGNRAFFKGNLFCSLGEPPIEAVFGVPKNRKAFF

SEQ ID NO: 52 - DNA, 852 bp, Chlamydia trachomatis
atgccgcaccaagtcttattgtctcctgtttgcgatcttttatcgaatgctgaaggtatagagacgcaagtactgtttggagaaaggatatgcaaccataaccatcgacactatgcctattctcaactagtcttttcttctatatggaagccataccctggcgactctctacagaatattcctctattctcttcccaactgcagcctcctaatgctgttgtctgctctcaagaagcttttttagatccttggcatatccccttaccttttgccgctccgctccacatagataaccaaaatcaagtgtccctatctcctgctagcatagcattattaaattccaattccagaagtaactatgcaaaagctttctgctctaccaaagagattcgttttttaaattcttcattctctccaagagatttagtttctttcgcagaacaattgatagatactccgtacgtttggggtggccggtgcattcataaacagcttcctcgtaatggtgtagattgttcggggtatattcaactactttaccaagtcacaggaagaaatatccctcgcaatgctagagatcaatacagagactgttctccagtaaaagatttctcgtctctacctataggaggacttatcttcctcaagaaagcaagcacgggacaaatcaaccatgttatgatgaaaatctcggagcatgaattcattcatgctgcggaaaaaatagggaaagtagaaaaagtaatcctaggaaatagggctttctttaaagggaatctattctgctcattaggtgaaccgcctatagaagctgtttttggcgttcctaaaaatagaaaagccttcttttga

SEQ ID NO: 53 - protein, 178 aa, Chlamydia trachomatis
MTYSISDIAHKSDISNPTSPAPSRKRGSFPPQSPSAVGSLEGANFSTWGPGPFFTVPVYPQQLAAMQNNLFTLQTEVSALKKKLVQSSQTRGSLGLGPQFLAACLVAATILAVAVIVLASLGLGGVLPFVLVCLAGSTNAIWAIVSASITTLICCVSIACIFLAKCDKGSDPQTLYVS

SEQ ID NO: 54 - DNA, 537 bp, Chlamydia trachomatis
atgacgtactctatatccgatatagcacacaaatctgatatttctaatcccacgtctcccgctccatcaagaaaacgaggatcctttcccccacaatctccttctgccgtgggctctttagagggagctaatttctctacatgggggccaggccccttcttcactgtccctgtttatccacaacaactcgctgcaatgcaaaacaacctttttacattgcaaacagaggtttctgctctcaagaaaaaattagttcagtctagtcagacacgcggatctttaggactcggcccgcagtttttagcggcatgcttagttgctgcgacaatccttgcagtagctgttatcgtacttgcttccttaggacttggcggtgttcttccttttgtccttgtttgtctggctgggtcaactaatgcaatttgggctattgtgagcgcctccatcactacactgatttgttgcgtttccatcgcttgcatcttcttagcaaaatgtgataagggatctgatcctcaaactttatatgtaagctaa

SEQ ID NO: 55 - protein, 792 aa, Chlamydia trachomatis
MLGIRKKTILQLAVLLLLTFSRSSFCSTSEGRMVVESITITTQGENTQNKRAIPKIKTKQGTLFSQADFDEDLRTLSKDFDRVEPLVEFRNGQAVISLILTAKPVIREINISGNEAIPTHKILKTLELYKNDLFDRELFFKNFDALRTLYLKRGYYDSQLSYSHNHNEKEGFIDISIELKEGRHGRIKKLTISGITRTEASDLGDIVLTKQYSTTTSWFTGAGVYHPDMVEQDLFAITNYFQNKGYADAKVSKEVSTDAKGNITLLIVVDKGPLYTLGHVHIEGFTALSKRLLDKQLLVGPNSLYCPDKIWTGAQKIRSAYARYGYVNTNVDVSFSAHPTLPVYDVTYRVSEGSPYKIGLIKIKGNTHTKHDVILHETSLFPGDTFDRLKLEGTETRLRNTGYFKSVSVYTVRSQLDPLDSNDLYRDVFIEVKETETGNLGLFLGFSSIDHLFGGAEIAESNFDLFGARNFLKKGFKSLRGGGEYLFLKANLGDKVTDYTVKWTKPHFLNTPWILGVELDKSINKALSKDYSVDTYGGNISTTYILNDKLKYGMYYRGSQTSLSLRKKTSSSNRPGPDLDSNKGFVSAAGLNVLYDSIDNPRKPTMGIRSSLNFELSGLGGTYQFTKLTASGSIYRLLTKKGVLKVRAEAKFIKPFGTTTAQGIPVSERFFLGGETTVRGYKPFIIGPKFSPTEPQGGLSSLLLTEEFQYPLISQPCINAFVFLDSGFIGIEEYTIRLKDLCSSAGFGLRFDMMNNVPIMLGWGWPFRPTEILNNEKIDVSQRFFFALGGVF

SEQ ID NO: 56 - DNA, 2379 bp, Chlamydia trachomatis
atgcttggaatacgcaaaaaaacgattctgcaactcgctgttttactgttgctcaccttttcacgaagttctttctgttcaacttcagaaggacgtatggtcgtagagtctatcaccattacgactcaaggagagaatactcaaaataaacgagctattcctaaaataaaaacaaagcaggggacgttgttctctcaagcagattttgatgaagatctaagaacactttcgaaagattttgatcgagtagagcctatcgtagagtttcgtaatggacaagctgtgatctctctgattctgacggcaaaacctgttatcagagagatcaatatttcaggaaatgaagctatccccactcataaaattctgaaaactttagagctttataaaaatgatctttttgatcgggaattattctttaaaaattttgatgcgctaagaactctttatttgaaacgagggtactacgattctcaactctcctattctcataatcataatgagaaagagggctttatcgatatttccatcgagattaaagaaggacgtcacggtcgcataaaaaaattaacgatttcgggaattacgcgaacagaagcatcagacttaggtgacattgttttaactaaacaatactccacaacaacgagctggttcactggtgccggagtgtatcatccggacatggtagagcaagacttatttgctatcacaaattacttccaaaataaaggatatgctgatgctaaagtaagcaaagaggtctctacagatgctaaaggaaacattactttgcttatcgttgtagacaaaggacctttatacacattaggtcacgtacatatagaaggattcacagcgttatccaaaagactgctcgataaacaactattggttggacctaactccttatattgcccagataaaatttggactggagcacaaaagattcgtagcgcatacgctagatatggctacgtgaacactaacgttgatgtctccttctcagcgcaccccactctacctgtttacgatgttacctatcgagtgagtgaaggatctccctacaaaatcgggttaattaaaatcaaagggaacactcatactaagcatgatgtgattttgcatgagactagtcttttccctggagacacttttgatagattaaaactggaaggtacagagactcgtttacgcaacaccggctactttaaaagtgtaagtgtctatacggttcgttcccaattagatcctcttgattctaacgacctttatcgagatgtttttattgaagtcaaagagactgaaacaggaaatcttgggctattcttaggattcagctccattgaccatttatttggaggggcagaaattgcagaaagcaactttgatttatttggagcccgaaactttctcaaaaaaggattcaaatctttaagaggtggtggagaatacctcttcctaaaagctaatttaggagataaggtcaccgattacactgttaaatggacgaaaccacacttcttaaataccccttggattcttggagtagaattagataaatcaattaataaagctttatcaaaagactactctgtggatacctatggagggaatatcagtaccacctacattcttaacgataagttaaaatatgggatgtattaccgtggtagccaaacaagcttaagtttgcgcaaaaaaacgtccagctctaatagacctggaccagatttagatagtaataaaggatttgtttccgcagcgggactcaatgttctctatgattctattgataatcctagaaaacctactatgggaatccgcagctccttaaactttgaattatctggtttaggcggaacttaccaatttactaaactaacagctagtggttctatctatcgcttattaactaaaaaaggtgttttgaaagtccgtgcagaagctaagtttatcaaacctttcggaacaacaactgcacaaggcattcctgtcagcgaacggttcttcttaggaggtgaaaccactgttcgcggttacaaaccttttattattggaccgaaattttctcctactgaaccacaaggaggcttgtcttccctactattaacagaagaatttcaatatcctttgatttctcaaccttgcattaatgcctttgtatttctagattccggattcattgggatagaagagtacactattcgcctgaaagacctttgcagtagcgccggatttggtctacgctttgatatgatgaataatgtgccaattatgctaggctggggttggccgttccgcccaacagaaatcctcaataatgaaaaaattgatgtatctcaaagattcttttttgccttgggaggagtattctag

SEQ ID NO: 57 - protein, 173 aa, Chlamydia trachomatis
MKKFLLLSLMSLSSLPTFAANSTGTIGIVNLRRCLEESALGKKESAEFEKMKNQFSNSMGKMEEELSSIYSKLQDDDYMEGLSETAAAELRKKFEDLSAEYNTAQGQYYQILNQSNLKRMQKIMEEVKKASETVRIQEGLSVLLNEDIVLSIDSSADKTDAVIKVLDDSFQNN

SEQ ID NO: 58 - DNA, 522 bp, Chlamydia trachomatis
atgaaaaagttcttattacttagcttaatgtctttgtcatctctacctacatttgcagctaattctacaggcacaattggaatcgttaatttacgtcgctgcctagaagagtctgctcttgggaaaaaagaatctgctgaattcgaaaagatgaaaaaccaattctctaacagcatggggaagatggaggaagaactgtcttctatctattccaagctccaagacgacgattacatggaaggtctatccgagaccgcagctgccgaattaagaaaaaaattcgaagatctatctgcagaatacaacacagctcaagggcagtattaccaaatattaaaccaaagtaatctcaagcgcatgcaaaagattatggaagaagtgaaaaaagcttctgaaactgtgcgtattcaagaaggcttgtcagtccttcttaacgaagatattgtcttatctatcgatagttcggcagataaaaccgatgctgttattaaagttcttgatgattcttttcaaaataattaa

SEQ ID NO: 59 - protein, 708 aa, Chlamydia trachomatis
MNKLLNFVSRTFGGDAALNMINKSSDLLLAMWMLGVVLMIILPLPPAMVDFMITINLAISVPLLMVALYIPSALQLSVFPSLLLITTMFRLGINISSSRQILLHAYAGHVIQAFGDFVVGGNYVVGFIIFLIITIIQFIVVTKGAERVAEVAARFRLDAMPGKQMAIDADLRAGMIDATQARDKRSQIQKESELYGAMDGAMKFIKGDVIAGIVISLINIVGGLVIGVTMKGMTMAQAAHIYTLITIGDGLVSQIPSLLISLTAGIVTTRVSSDKDTNLGKEISSQLVKEPRALLLSAGATLGIGFFKGFPLWSFALMAVLFAVLGILLITKKNSPGKKGGASSTTTVGAADGAAASGENSDDYALTLPVILELGKDLSKLIQQRTKSGQSFVDDMIPKMRQALYQDIGIRYPGIHVRTDSPSLEGNDYMILLNEVPYVRGKIPPNHVLTNEVEENLSRYNLPFITYKNAAGLPSTWVSTDALTILEKAAIKYWSPLEVIILHLSYFFHRNSQEFLGIQEVRSMIEFMERSFPDLVKEVTRLIPLQKLTEIFKRLVQEQISIKDLRTILESLSEWAQTEKDTVLLTEYVRSSLKLYISFKFSQGQSAISVYLLDPEIEEMIRGAIKQTSAGSYLALDPDSVNLILKSMRMTITPTPPGGQPPVLLTAIDVRRYVRKLIETEFPDIAVISYQEVLPEIRIQPLGRIQIF

SEQ ID NO: 60 - DNA, 2127 bp, Chlamydia trachomatis
atgaacaagctactcaactttgtcagtagaacattcgggggagatgcggccctgaatatgataaacaagtccagtgacctgatcctcgccatgtggatgttaggcgtggtcttgatgatcattttgccattgcctccagctatggtggactttatgatcaccattaacttggcgatctctgtgttcctgctgatggttgccttgtatattcccagcgcattacaactttctgttttcccctccttactcttaatcaccacaatgttccgattggggattaacatttcttcctcccgacaaattctccttcatgcttatgctggtcacgtgatccaagccttcggagacttcgtcgttggaggaaactatgtcgttggatttattatcttcctaatcatcaccatcattcagtttatcgtggtaacaaaaggtgcggagagggtcgctgaggtagctgctcgattccgattagatgccatgcctggtaaacagatggccatcgatgccgacctacgagcaggaatgattgatgcgacacaagctcgtgataagcgatctcagattcagaaagaaagtgaactttatggagctatggacggagccatgaagttcattaagggagacgtgatcgcagggattgttatctccttgattaacatcgtaggaggattagtcatcggagtgaccatgaagggcatgacgatggctcaagccgcgcacatctacacgttgattacgatcggtgacgggttagtttctcaaatcccctctctgttaatctctttaacagctggtatcgtaaccactcgagtatctagtgataaagacactaaccttggtaaggaaatttctagccagttggttaaagaacctcgggcacttctcctatccgcaggcgcaaccttaggaatcggattcttcaaaggtttccctttatggtcatttgctttaatggccgttctctttgcagtattaggtattctgttaatcactaagaaaaactctccagggaaaaaaggcggagccagctctactactacagtaggtgccgctgatggagctgcggcttcaggagaaaattctgatgattatgctctgactcttcctgtaattcttgaacttggaaaagatctttctaaactcatccaacaacgaaccaaatcggggcaaagttttgtggatgatatgattcctaaaatgcgtcaggctctctatcaggatattggaattcgttatccaggaatccatgtacgtacagactccccttccttggaaggtaatgactatatgattctgctgaatgaggttccctacgttcgcggaaaaattccaccaaatcatgtgttaacaaatgaagtagaagaaaacttatctcggtataacttaccttttattacttacaaaaatgctgcaggattgccttccacttgggttagtacagatgctctcactatcttagagaaagctgcgattaaatactggtctcctttggaagtgattattcttcacttgtcctacttcttccatagaaattctcaagagttcttaggcattcaggaagtacgctctatgattgaatttatggaacgttccttccctgatcttgttaaagaggttacccgtcttattcctctacagaagcttacagaaatctttaagcgtttagttcaagaacaaatatccattaaggatttacgaactattttggaatctttgagcgaatgggcacagacggaaaaagatacagtattacttactgaatatgtgcgctcttccttgaaactctatatcagcttcaagttctctcaagggcaatccgctatttctgtatatctactcgatcctgaaattgaagagatgatccgcggagcaatcaaacaaacttctgcaggatcttatttggctttagatccagattctgtaaacctcatcttaaaatctatgcggatgactattactcctacacctcctggaggacagcctcctgtgctgttgacagcaattgatgtcagacgctatgtacggaaattgatagagacagaattccctgatatcgctgtgatttcttaccaagaagttttacctgaaattagaatccagcctttgggaagaattcaaattttctaa

SEQ ID NO: 61 - protein, 421 aa, Chlamydia trachomatis
MTASGGAGGLGSTQTVDVARAQAAAATQDAQEVIGSQEASEASMLKGCEDLINPAAATRIKKKGEKFESLEARRKPTADKAEKKSESTEEKGDTPLEDRFTEDLSEVSGEDFRGLKNSFDDDSSPDEILDALTSKFSDPTIKDLALDYLIQTAPSDGKLKSTLIQAKHQLMSQNPQAIVGGRNVLLASETFASRANTSPSSLRSLYFQVTSSPSNCANLHQMLASYLPSEKTAVMEFLVNGMVADLKSEGPSIPPAKLQVYMTELSNLQALHSVNSFFDRNIGNLENSLKHEGHAPIPSLTTGNLTKTFLQLVEDKFPSSSKAQKALNELVGPDTGPQTEVLNLFFRALNGCSPRIFSGAEKKQQLASVITNTLDALNADNEDYPKPGDFPRSSFSSTPPHAPVPQSEIPTSPTSTQPPSP

SEQ ID NO: 62 - DNA, 1266 bp, Chlamydia trachomatis
atgactgcatcaggaggagctggagggctaggcagcacccaaacagtagacgttgcgcgagcacaagctgctgcagctactcaagatgcacaagaggttatcggctctcaggaagcttctgaggcaagtatgctcaaaggatgtgaggatctcataaatcctgcagctgcaacccgaatcaaaaaaaaaggagagaagtttgaatcattagaagctcgtcgcaaaccaacagcggataaagcagaaaagaaatccgagagcacagaggaaaaaggcgatactcctcttgaagatcgtttcacagaagatctttccgaagtctccggagaagattttcgaggattgaaaaattcgttcgatgatgattcttctcctgacgaaattctcgatgcgctcacaagtaaattttctgatcccacaataaaggatctagctcttgattatctaattcaaacagctccctctgatgggaaacttaagtccactctcattcaggcaaagcatcaactgatgagccagaatcctcaggcgattgttggaggacgcaatgttctgttagcttcagaaacctttgcttccagagcaaatacatctccttcatcgcttcgctccttatatttccaagtaacctcatccccctctaattgcgctaatttacatcaaatgcttgcttcttacttgccatcagagaaaaccgctgttatggagtttctagtaaatggcatggtagcagatttaaaatcggagggcccttccattcctcctgcaaaattgcaagtatatatgacggaactaagcaatctccaagccttacactctgtaaatagcttttttgatagaaatattgggaacttggaaaatagcttaaagcatgaaggacatgcccctattccatccttaacgacaggaaatttaactaaaaccttcttacaattagtagaagataaattcccttcctcttccaaagctcaaaaggcattaaatgaactggtaggcccagatactggtcctcaaactgaagttttaaacttattcttccgcgctcttaatggctgttcgcctagaatattctctggagctgaaaaaaaacagcagctggcatcggttatcacaaatacgctagatgcgataaatgcggataatgaggattatcctaaaccaggtgacttcccacgatcttccttctctagtacgcctcctcatgctccagtacctcaatctgagattccaacgtcacctacctcaacacagcctccatcaccctaa

SEQ ID NO: 63 - protein, 361 aa, Chlamydia trachomatis
MKKTKHLISKIMFSLVSLFVGGFLLKAPAPTQSADTFQTLIESKEPVIFTKQCGDNVTQILCDAIDSAKKDIFLSIYDLSAPAITTSLKKQVSARIPVCIHYQRISKNAEFSQSPYLTLGEHPPMHRKLMHQKTMAIDGELAWIGSANFTLASLEKSANLIIGLKSAEICHFIKTQTSGRCFINNQLIEYFSFDGGSSAALETVLHHIRSAKESIQVGMFALTLPQLLAELNAAQNCGVDVVILVDKGYKSFTVQQIKQLEHPSLSIYEKVTPYQLHHKFGIFDKKTLITGSVNWSENGFLINTEDMIVIENLTEKQQSKIQAIWEGLVRECALYYSPDQEEKEKDPLIIPFPPSEKKQAA

SEQ ID NO: 64 - DNA, 1086 bp, Chlamydia trachomatis
atgaaaaaaacaaaacaccttatttccaaaataatgttcagcttagtttccctttttgttggaggatttttactaaaagccccagccccgactcaatctgctgataccttccaaacgcttattgaatccaaggaacctgttatcttcaccaaacagtgtggagacaatgtaacgcaaatactatgtgatgcgatagactctgcaaaaaaagatatttttctcagtatttatgacctatctgctcccgctatcacgacaagtttgaaaaaacaagtgtccgctcgcattcctgtatgtattcattaccaacgtatctctaaaaatgcggagttctctcagtctccctatcttaccttgggagaacatcctcccatgcacagaaaactcatgcatcaaaaaactatggcaatagatggagaactcgcttggatcggatctgctaattttacattagcttcgttagagaagagcgctaacctaataattggattaaaaagcgcagaaatttgtcattttattaaaacgcaaacctctggtcggtgctttattaacaatcaactcatcgagtatttttcctttgatggggggagttctgctgctctagaaacagttcttcaccatattcgatcagcgaaagaatccatccaagtaggtatgtttgctctcactttacctcagattattgctgaattgaatgccgcacaaaactgtggtgttgatgtagtgatcctcgtcgacaaaggatacaaatcctttaccgtacagcaaattaagcaattggaacatcctagtctctctatttatgaaaaggtaaccccgtaccaactacatcataaatttggcattttcgataaaaagacgctaattacaggatctgtcaattggtctgagaatggcttccttattaatacagaagacatgattgtcattgaaaatctgacagaaaaacagcaaagcaaaatacaggcgatatgggaaggattagtaagagagtgtgctttgtattactccccagatcaagaggaaaaagaaaaagatcctttaatcattccgttccctcctagcgaaaaaaaacaagctgcttga

SEQ ID NO: 65 - protein, 316 aa, Chlamydia trachomatis
MGKFFASYLLILAPFFLQSCSAPSRTTLEGVRMTIPYRIVFGEALSPDAFQQAQKEIDRVFDHIDQTFNNWNPLSEISRINRTTKQTPIPLSPALFAFLCEIDHFHAFSDGRFDPTLGALKSLWLLHLKSHTIPSQELQHLYKHSSGWHLISLDKTQQTLRKLSPLVQLDLCGTVKGFAVDLLGTACAQFCQNYYVEWGGEIKTKGKHPSGRSWAVASSATPEILHLHDHAIATSGSQYQRWHVDNKTYTHILDPLTGTPLEDSSHPLLAVSVINESCAFADAMATALTTFSSKQEALDWANKKHLCAYITDKNVS

SEQ ID NO: 66 - DNA, 951 bp, Chlamydia trachomatis
atgggaaagttttttgcgtcatacctcctgatcctagcccccttcttcctccaatcctgttcagctccttcaagaactactcttgaaggggtccgtatgacaattccttatcgcattgtatttggagaagcactttctccagatgcattccaacaagcgcaaaaggaaattgatcgagtgtttgatcatatcgatcaaacttttaataattggaatcctctatccgaaatttcccgtattaatcgcaccacaaaacaaacccctatccccttatcgccagcactctttgcttttctatgcgaaatagaccatttccacgccttctctgatggccgttttgatcccaccttaggcgctttaaaaagcttatggctactgcacctaaaatcccataccatcccttctcaagagctccaacacctctacaaacacagctctggatggcatctgatttctcttgataaaacccagcaaactttaaggaaactttcgcctctcgtccaattagatctctgcggaactgtaaaaggttttgctgtagatctattaggaacagcttgtgctcaattctgtcaaaattactacgtagaatggggaggagaaatcaaaaccaaagggaaacatccttccggaagatcttgggctgtcgcttcatcagctaccccagagattcttcatctgcatgatcatgctatagcgacgagcgggagtcaatatcaacgatggcatgtggacaacaaaacctacacccacattcttgacccattaacgggaactcctctagaagatagcagccatcccatccttgcagtttccgtgatcaacgaaagctgcgcctttgcggatgctatggctactgcactgacgaccttctcctctaaacaagaagctcttgactgggcaaataagaaacatctttgcgcatatattaccgataagaacgtttcatag

SEQ ID NO: 67 - protein, 326 aa, Chlamydia trachomatis
MSFFHTRKYKLILRGLLCLAGCFLMNSCSSSRGNQPADESIYVLSMNRMICDCVSRITGDRVKNIVLIDGAIDPHSYEMVKGDEDRMAMSQLIFCNGLGLEHSASLRKHLEGNPKVVDLGQRLLNKNCFDLLSEEGFPDPHIWTDMRVWGAAVKEMAAALIQQFPQYEEDFQKNADQILSEMEELDRWAARSLSTIPEKNRYLVTGHNAFSYFTRRYLSSDAERVSGEWRSRCISPEGLSPEAQISIRDIMRVVEYISANDVEVVFLEDTLNQDALRKIVSCSKSGQKIRLAKSPLYSDNVCDNYFSTFQHNVRTITEELGGTVLE

SEQ ID NO: 68 - DNA, 981 bp, Chlamydia trachomatis
atgtctttttttcatactagaaaatataagcttatcctcagaggactcttgtgtttagcaggctgtttcttaatgaacagctgttcctctagtcgaggaaatcaacccgctgatgaaagcatctatgtcttgtctatgaatcgcatgatttgtgattgcgtgtctcgcataactggggatcgagtcaagaatattgttctgattgatggagcgattgatcctcattcatatgagatggtgaagggggatgaagaccgaatggctatgagccagctgattttttgcaatggtttaggtttagagcattcagctagtttacgtaaacatttagagggtaacccaaaagtcgttgatttaggtcaacgtttgcttaacaaaaactgttttgatcttctgagtgaagaaggattccctgacccacatatttggacggatatgagagtatggggtgctgctgtaaaagagatggctgcggcattaattcaacaatttcctcaatatgaagaagattttcaaaagaatgcggatcagatcttatcagagatggaggaacttgatcgttgggcagcgcgttctctctctacgattcctgaaaaaaatcgctatttagtcacaggccacaatgcgttcagttactttactcgtcggtatctatcctctgatgcggagagagtgtctggggagtggagatcgcgttgcatttctccagaagggttgtctcctgaggctcagattagtatccgagatattatgcgtgtagtggagtatatctctgcaaacgatgtagaagttgtctttttagaggataccttaaatcaagatgctttgagaaagattgtttcttgctctaagagcggacaaaagattcgtctcgctaagtctcctttatatagcgataatgtctgtgataactattttagcacgttccagcacaatgttcgcacaattacagaagaattgggagggactgttcttgaatag

SEQ ID NO: 69 - protein, 605 aa, Chlamydia trachomatis
MQNILRTSSCRYMFLLGIRSVWNRVAVVNNFRGSSWKIVAIPSCILFTLIFHLPRWLIDFGVCTNLACSLSIIFWVFSLRSSASARIFPSLLLYLCLLRLGLNLASTRWILSSGWASPLIFALGNFFSLGSIPVALTVCLLLFLVNFLVITKGAERLAEVRARFSLEALPGKQMSLDADLAAGRIGYSRASVKKSSLLEESDYFSAMEGVFRFVKGDAIMSWVLLGVNLLAALFLGRATHVGDLWLTVLGDALVSQIPALLTSCAAATLIAKVGEKESLAQHLLDYYEQSRQSFLFIALILCGMACIPGAPKALILGFSVLLFLGYKNPSSGETLLFQKERVEFVLPDEGVGNPANLYKDARNQIYQELGVVFPEAIVVRHVTGSSPRLIFSGQEVALRELSCPAILESIRQLAPETISERFVTRLVDEFREHAFLSIEEILPLKISENSLIFLLRALVRERVSLHLFPKILEAIDVYGSQPKNSQELVECVRKYLGKQIGLSLWNRQDVLEVITIDSLVEQFVRDSQEKVVLDLNEKVVAQVKHLLRVGEGNFRAIVTGSETRKELKRIVDPYFPDLLVLAHSELPEEIPITLLGAVSDEVLLS

SEQ ID NO: 70 - DNA, 1818 bp, Chlamydia trachomatis
atgcaaaatattcttcgaacttcttcttgcagatatatgtttttgctgggtattcgttcggtgtggaatcgggtggctgttgtgaataactttagaggaagttcatggaaaattgtagcaatccccagttgtatactgtttactttgatattccatttacctagatggctgattgattttggggtatgtacaaatttagcgtgctccttgtcgatcattttttgggtgttttctctacgctcttcagcttcggctcgtattttcccttctctccttttgtatctttgtctattgcgacttggcctgaatttagcctccacccgatggattttatcttctggatgggcttctcctttaatttttgcgttagggaatttcttttcccttgggagcatcccggttgctcttacggtatgtttactcctgtttttagtgaattttctcgtcataactaaaggagcagagcgtattgcggaagtgcgagctcgtttttcattagaagcgctcccaggtaaacaaatgtctttagatgctgatattgctgctggaaggatcgggtatagcagagcgtctgttaaaaaaagctctcttttagaagagagtgattacttctccgccatggagggcgtattccgctttgtaaaaggcgatgcgataatgagttgggtgttgttaggagtgaatatcctagctgctctgtttttaggacgagctactcatgttggcgatttgtggttaactgtattaggcgatgctttagtgagtcaaattccagcattgcttacatcgtgtgcagcagcaacgcttatagctaaagttggggaaaaagaaagtctagcgcagcatctgctagattattatgagcagagtcgccagagttttctttttatcgctttgatcctatgtgggatggcttgtattccaggagctcctaaagctctgatcctaggtttttcagttttattattcttagggtataagaatccttcttcaggagagactcttctcttccagaaagaacgggtagagtttgtattgcctgatgagggagtgggaaatcctgctaatttgtacaaggacgcccgcaatcagatttatcaagagttaggcgtagttttcccggaagctattgttgtacgtcatgtaacaggatcttctccacgtttaatcttttctgggcaagaggtcgctttgagagagctgtcttgcccagctatactagaatcgattaggcagctagctccagaaacgatcagtgaacgcttcgttactcgcttagttgatgagtttcgagagcatgcattcttatcgatagaagagatccttccgttaaaaatatcagagaattctttgattttcttattgagagctcttgttagagaacgagtgtctttgcatttattccctaagattctcgaagctatagatgtatatggctctcaaccaaagaattctcaggaattggtagagtgtgtacgaaaatatcttgggaagcaaattggtttatccttatggaatcgccaagatgtcttagaggtaattacgatagactctctggttgagcagtttgtgagagattcacaagaaaaggttgtgttggatttaaatgaaaaagtagttgctcaggtgaagcatttattgcgggtaggggaggggaattttcgagctatcgtaacgggatccgaaacaagaaaagaactgaaacgcatagtggatccttatttcccagatttattggttttagcacatagcgaacttccagaagagatccctataactttgttaggagcggtgtctgatgaggttttattatcataa

SEQ ID NO: 71 - protein, 499 aa, Chlamydia trachomatis
MVLLYSQASWDKRSKADALVLPFWMKNSKAQEAAVVDEDYKLVYQNALSNFSGKKGETAFLFGNDHTKEQKIVLLGLGKSEEVSGTTVLEAYAQATTVLRKAKCKTVNILLPTISQLRFSVEEFLTNLAAGVLSLNYNYPTYHKVDTSLPFLEKVTVMGIVSKVGDKIFRKEESLFEGVYLTRDLVNTNADEVTPEKLAAVAKDLAGEFASLDVKILDRKAILKEKMGLLAAVAKGAAVEPRFIVLDYQGKPKSKDRTVLIGKGVTFDSGGLDLKPGKAMITMKEDMAGAATVLGIFSALASLELPINVTGIIPATENAIGSAAYKMGDVYVGMTGLSVEIGSTDAEGRLLLADAISYALKYCNPTRIIDFATLTGAMVVSLGESVAGFFANNDVLARDLAEASSETGEALWRMPLVEKYDQALHSDIADMKNIGSNRAGSITAALFLQRFLEDNPVAWAHLDIAGTAYHEKEELPYPKYATGFGVRCLIHYMEKFLSK

SEQ ID NO: 72 - DNA, 1500 bp, Chlamydia trachomatis
gtggtattactctattctcaagcgagttgggataaacgatcaaaagcggatgctcttgttcttcctttttggatgaagaattctaaagctcaagaagctgcggttgttgatgaggactacaagcttgtctatcaaaacgcattatccaatttttcagggaagaaaggggaaacggcttttctttttggaaatgatcacacaaaagaacaaaaaattgttcttcttggtctagggaagagcgaagaagtatccggaacaaccgttttagaagcctacgctcaggctactactgttttaagaaaagctaagtgtaagactgtaaatattttactcccaacaatttcacagttgcgcttctccgtagaagagtttttaacgaacttggcagcaggggtgctatctctgaactataattacccaacctatcacaaagtggatacgtctttgcctttcctagagaaagtgactgtaatgggtattgtctctaaggtaggggacaagatctttagaaaagaagagagcctatttgaaggggtatatttaactagagatttagtgaataccaatgcagatgaagtcactccagaaaaacttgctgcggtagcaaaagatctagcaggggagttcgcgagtctggatgtaaaaattctagataggaaggcgatattaaaagaaaaaatgggattgttggctgctgttgccaagggcgctgctgttgagcctcggtttattgttctggattaccaaggtaaacctaaatctaaagatagaaccgtactcattggtaaaggggtaacattcgattccggaggactagatttgaaacctgggaaggcaatgattaccatgaaggaagacatggctggagcggctaccgttctaggaattttttctgctttagcttccttagagcttccgatcaatgtgaccgggatcattccagctacagagaatgcaattggatcggctgcctataagatgggagatgtatatgttggaatgaccggcctttctgtagaaattggcagcactgatgcggaagggcgtttgattttagcagatgccatctcctatgctttgaaatattgtaatcctacccgcatcattgactttgctaccttgacgggtgctatggttgtttctttaggagaatctgtggctggattttttgcaaataacgacgtgttggcaagagatctagcagaagcttcatcagagaccggggaagctctatggagaatgcctttggtagagaaatatgaccaggcacttcattcagatattgcagatatgaaaaatatcggcagcaatcgtgcaggatcgattactgcagcgctatttttacaacgtttcctcgaagacaatccagtagcatgggcacatttggacattgcaggtactgcttaccatgaaaaagaagagttgccttaccccaaatatgcaacaggatttggtgtgcgttgtttaattcattatatggagaaattcctatctaaatag

SEQ ID NO: 73 - protein, 414 aa, Chlamydia trachomatis
MFSSAIVILTAIFVLCSGFVSLSHIALFSLPSSLIAHYSHSKNRQLRQIANLMAYPNHLLMTLVFFDIGINIGVQNCIATLVGDSASLLLTVGVPLALTLVLGEIVPKVIAIPYNARIAKIVTPIIFASTKSFRPIFDWAISGINFIVQKMLARQESDFIQPQELKEVLRSCKDFGVVNHEESRLLFGYLSMEEGSIKERMTPKQEIIFYDVLTPIENLYKLFSGPKQSYSKVLVCKGGLQNLLGVCSAKLLLLYKEKLQSAEELLPLLRKPHYIPETVSAKTALYHLAGEDCGLGIIIDEYGSIEGLITQNDLFKIVSDGVAHNRPSFKQFAHSDKNVVIAAGTYELSDFYDLFGVDLPTTANCVTIGGWLTEQLGEIPETGTKFAWGQFVFQILDAAPNCVKRVYIRKTHGN

SEQ ID NO: 74 - DNA, 1245 bp, Chlamydia trachomatis
atgttttcttcagcaattgttattctaactgcaatttttgtcttgtgctcggggtttgtttctttatcgcatatagctttattctcgctcccttcttcccttattgctcattacagtcactcaaaaaataggcagctccgacaaattgccaatcttatggcctaccccaatcatttgctcatgaccctagtcttcttcgacatagggattaatattggagtgcaaaactgcatagcaaccttagtaggcgattcggcatctctattgcttaccgtaggagttcccctcgctttgacactagttttgggagaaattgtccctaaggttatcgcaatcccttacaatgcacgaattgcaaagattgtaaccccaatcatctttgcctcaactaaaagcttccgccctatatttgattgggctatctcgggtatcaattttatcgttcagaaaatgttggcccgtcaagaaagtgattttattcaaccccaagaattaaaagaagtcctccgaagctgtaaagatttcggagttgtaaatcatgaggaaagtcgtcttctatttggctatctatccatggaagaaggtagcattaaagaacgcatgacgcccaaacaagaaatcattttttatgatgtccttactccgattgaaaatttatataaactcttctctggacctaaacaaagctattccaaagttctagtttgtaaaggtggtctacaaaatctcttaggagtttgttctgcaaaattgcttcttctctacaaagaaaaattacaatctgccgaagaactcttgcctctccttcgtaaacctcactacattcctgaaacagtatcagctaagacagctttgtatcatctagcaggagaagactgtggtttaggtattatcattgatgaatatgggtctatagaaggattgatcacccaaaatgatctatttaaaatagtctctgatggggtagctcataatcgcccatcttttaaacaattcgctcactcagacaagaatgttgttattgctgcaggcacctatgagctttctgatttctatgacctgtttggagttgatcttcctactacagctaattgcgttaccataggcggatggctgacagaacaattaggagaaatccctgaaacaggaacaaaattcgcttggggacaatttgtattccaaatactagacgcggctcctaattgtgtgaaacgggtgtatataaggaaaacccatggaaactaa

SEQ ID NO: 75 - protein, 215 aa, Chlamydia trachomatis
MRKFWLLASFGLLSLTTTTLSSCAVSNSGSYNARLYTKGSKAKGVVAMLPVFYRTEKSAELLPWNLQAEFSEEISRRLHSSDKLLLIKHHASAGVAAQFFSPTPNISPELATQLLPAEFVVAAEILEQKTTEDVLNPSISASVRVRVFDIRHNKVSMIYQEILDASQSLASGSNDYHRYGWRSKNFDSTPMGLMHQRLFREIVARVEGYVCANYS

SEQ ID NO: 76 - DNA, 648 bp, Chlamydia trachomatis
atgcgaaaattctggttacttgcttctttcggccttttgtctttaactacgactactctttctagctgtgctgtatctaattctggcagctacaatgctagactatacactaaagggagcaaggctaaaggagtcgtcgccatgctacctgttttttatcgaacagaaaagtctgcagaactactcccttggaatttacaagcagagttttccgaagagattagcagacgtttgcactcttctgataaactacttttaatcaaacaccacgcttcagctggtgttgctgcacaatttttttctcctactcctaatatttcgcccgaattagcgactcagctgttgcctgcggaattcgtagttgcggcagaaattttagaacagaaaacaacggaagatgttttaaacccttctatttcagcatctgttcgtgtgcgagtgtttgatattcgtcacaataaagtctctatgatataccaagagattttagacgcgagtcaatctctcgcctctggaagcaacgattatcatcgttatggctggcgttcgaaaaacttcgattcgactccgatgggcctcatgcatcagagattatttagagagattgttgctcgcgtagagggatatgtctgcgcaaactactcttga

SEQ ID NO: 77 - protein, 398 aa, Chlamydia trachomatis
MLVESQLGLEDVLEAFSERNFDIQSKSFIESFQDKKLRRTVIQRFLHHPLLHIHDIARAAYLLAALEEGVDLGYQFLCMHQTQSGAALLFRRAGFLWGGLPYPGEHAEMAMLLSRIAEFYDTSYEQVQKMIAFQRALFSHERNIFPALWSQEGSRSNQEKTAVSKLLFCQKEARIEDQFTLTDMSLGFWMRRTPSFSAYVSGSGCKSGVGAFLIGDVGVLNYGPCVGDPGECLGFGLCGQVKEFSCQEKDEEVSISFAGALSQPSSRRTGFSYLQDALFSTNSCYCIDITEQKCHVASSLDRENQDAFFAIFCKGSQCQVCNGPKLRTGSPDSYKGPAYDVLIKGEKETVRILSSSPHMEIFSLQGKDRFWGSNFLINLPYTQNSINILFEKASEQID

SEQ ID NO: 78 - DNA, 1182 bp, Chlamydia trachomatis
atgctagtagaatcgcagttagggttagaggacgtattagaggcgttctctgagaggaattttgatattcaaagtaagagtttcatagagtctttccaggataagaagctgcgaagaaccgttatacagcgttttctacatcatccattgttacatattcatgatatcgctcgtgccgcttatttgctggcagctttggaagaaggggtagacttaggataccagttcctttgtatgcatcagacgcagtctggagcggctttattatttcgtcgagcaggttttttatggggaggccttccttatcctggggagcatgctgagatggctatgttgttgtctcgtattgcagagttttatgacacaagctacgagcaagttcaaaaaatgatagcttttcaacacgcattattttctcatgagagaaacattttccctgcattgtggagtcaagaaggctctagatccaaccaggaaaaaacagctgttagtaaattgttattttgccaaaaagaagcccgtatagaagatcagttcacgctaacagatatgtctcttggtttttggatgcgcagaacgccttctttttctgcttatgttagtggtagtggttgtaagagcggagtgggggcttttttgataggagatgtgggggttctcaactatggtccttgcgttggggatccaggagaatgtttgggatttggtttatgcggccaagtgaaagagttctcatgtcaagaaaaagacgaagaagtatcaatatcttttgcaggagctttgtcacagccttcttctaggagaacaggcttttcttatttgcaagatgctttgtttagcactaattcatgttattgtatagacattactgagcaaaagtgtcatgttgcttcttctttggatagggaaaatcaggatgcgttttttgctatcttttgtaagggatcgcaatgtcaagtatgcaatggtccaaaattgcgtacaggatctccagactcttataaaggcccagcctatgatgtattgattaaaggagaaaaagagactgttcggattttatcttctagtccgcatatggaaattttttctttacaaggcaaagatcggttttggggaagtaattttttgatcaatcttccctacacacaaaatagtataaacattttatttgaaaaggcttga

SEQ ID NO: 79 - protein, 474 aa, Chlamydia trachomatis
MKMAFLRKIFVFVACVVSLNGFAHTIAIPDGDKKAKVLIHDNGYEMYEHLLAAISSAKYTVELCPCLAGGEILSTVLQRLEQRMEEVPALVSYILVQPTCIDDNDRKNLKTLQENYPDRFFYLFSDWPPYCNVFFPNVTESHTKLSIVDGKYIFIGGSNLEDLQCSKGDVDLEVSDSPRAVIGGVLRPSAMRDQDVTIVSEEYGALLRKEFCAHYALWKDFTQKLWLNKKLDDFRGIDPINLSIEKARSSFCAMIETSLCAVSVPLDKMHFIFSGPDESNNTIAEEYVRLINQAQHSIRIAQMFFIPVAKIYDSLMAACWDRGVEIYLVTNGRTDRSPEITRSYAWGNRINYFPLTFGSRPLLWERFLYSPSRASMKFYVSEFYVANTQLHKKCMLVDDHILVIGSYNFGKKSNDCDYECIVVIDSKEAVSKAQVVFEKDLRLSKSVTHDDIINWYFDPVHYCLGYLEQRYMPS

SEQ ID NO: 80 - DNA, 1425 bp, Chlamydia trachomatis
atgaaaatggcttttttacggaaaatatttgtatttgtagcttgtgttgtctcgttgaatggttttgcacacactatagctattccggatggagacaaaaaagctaaggttcttattcatgataacggctatgaaatgtacgaacacctgttggccgctattagtagtgctaaatatactgtagaartgtgtccttgtttagcaggaggagagattttatccacagttcttcagcgcttggagcagcgtatggaagaagtgcctgcgcttgtaagctacatattggtccaacctacatgtattgatgataatgatcggaagaatttaaaaactctgcaagaaaattatcctgacaggtttttctacctgttttcagattggccaccgtattgtaatgtatttttccctaacgtgacagagtcgcatactaagttgtccattgttgatgggaagtacatttttatcggaggttcaaatttagaggatcttcaatgttctaaaggggatgtggatttagaagtctctgattcccctcgtgctgtgataggaggagtgcttcggccttcagctatgcgagatcaagatgtaacgattgtctcggaagaatatggagcattgctgagaaaagaattttgtgctcactatgctttgtggaaggatttcactcaaaaactatggttaaacaaaaaattagatgattttagaggcattgatccaatcaatctttctatagaaaaagctagatcctctttctgtgctatgattgagacgagcctttgtgctgtatctgtacctttagataaaatgcattttatcttttccggaccggatgaatcgaacaacacgattgctgaagaatatgttcggctgattaaccaagctcaacattctatccggatagcgcagatgttttttattccggtagcgaaaatatatgatagtctcatggctgcttgctgggatagaggcgtagaaatctatttagtaaccaatgggagaacggatcggagtcccgaaatcactagaagctatgcttggggaaatcgaattaattatttcccattgactttcggttctcggccgcttttgtgggaacgctttttgtattctcccagtcgagcctctatgaagttttatgtgagcgagttttatgtagctaatacacaactgcataaaaagtgcatgcttgtagatgatcatattttagttataggcagttacaattttggaaagaagagtaacgattgcgattacgaatgcattgtggtgattgattcaaaagaagcagtctctaaagctcaggtagtatttgaaaaagatttgcgactttctaaatcagtgactcatgatgacattataaactggtattttgatcctgtacattattgtttagggtacttagaacagagatacatgccatcttaa

SEQ ID NO: 81 - protein, 1013 aa, Chlamydia trachomatis; identical to SEQ ID NO: 5

SEQ ID NO: 82 - DNA, 3042 bp, Chlamydia trachomatis; identical to SEQ ID NO: 2

SEQ ID NO: 83 - protein, 1013 aa, Chlamydia trachomatis
MQTSFHKFFLSMLLAYSCCSLSGGGYAAEIMIPQGIYDGETLTVSFPYTVIGDPSGTTVFSAGELTLKNLDNSIAALPLSCFGNLLGSFTVLGRGHSLTFENIRTSTNGAALSDSANSGLFTIEGFKELSFSNCNSLLAVLPAATTNNGSQTPTTTSTPSNGTIYSKTDLLLLNNEKFSFYSNLVSGDGGAIDAKSLTVQGISKLCVFQENTAQADGGACQVVTSFSAMANEAPIAFIANVAGVRGGGLAAVQDGQQGVSSSTSTEDPVVSFSRNTAVEFDGNVARVGGGIYSYGNVAFLNNGKTLFLNNVASPVYIAAEQPTNGQASNTSDNYGDGGAIFCKNGAQAAGSNNSGSVSFDGEGVVFFSSNVAAGKGGAIYAKKLSVANCGPVQFLGNIANDGGAIYLGESGELSLSADYGDIIFDGNLKRTAKENAADVNGVTVSSQAISMGSGGKITTLRAKAGHQILFNDPIEMANGNNQPAQSSEPLKINDGEGYTGDIVFANGNSTLYQNVTIEQGRIVLREKAKLSVNSLSQTGGSLYMEAGSTLDFVTPQPPQQPPAANQLITLSNLHLSLSSLLANNAVTNPPTNPPAQDSHPAIIGSTTAGSVTISGPIFFEDLDDTAYDRYDWLGSNQKIDVLKLQLGTQPSANAPSDLTLGNEMPKYGYQGSWKLAWDPNTANNGPYTLKATWTKTGYNPGPERVASLVPNSLWGSILDIRSAHSAIQASVDGRSYCRGLWVSGVSNFFYHDRDALGQGYRYISGGYSLGANSYFGSSMFGLAFTEVFGRSKDYVVCRSNHHACIGSVYLSTKQALCGSYLFGDAFLRASYGFGNQHMKTSYTFAEESDVRWDNNCLVGEIGVGLPIVITPSKLYLNELRPFVQAEFSYADHESFTEEGDQARAFRSGHLMNLSVPVGVKFDRCSSTHPNKYSFMGAYICDAYRTISGTQTTLLSHQETWTTDAFHLARHGVIVRGSMYASLTSNIEVYGHGRYEYRDTSRGYGLSAGSKVRF

SEQ ID NO: 84 - DNA, 3042 bp, Chlamydia trachomatis; identical to SEQ ID NO: 2

SEQ ID NO: 85 - protein, 878 aa, Chlamydia trachomatis; identical to SEQ ID NO: 23

SEQ ID NO: 86 - DNA, 2637 bp, Chlamydia trachomatis; identical to SEQ ID NO: 8

SEQ ID NO: 87 - protein, 878 aa, Chlamydia trachomatis
MRPDHMNFCCLCAAILSSTAVLFGQDPLGETALLTKNPNHVVCTFFEDCTMESLFPALCAHASQDDPLYVLGNSYCWFVSKLHITDPKEALFKEKGDLSIQNFRFLSFTDCSSKESSPSIIHQKNGQLSLRNNGSMSFCRNHAEGSGGAISADAFSLQHNYLFTAFEENSSKGNGGAIQAQTFSLSRNVSPISFARNRADLNGGAICCSNLICSGNVNPLFFTGNSATNGGAICCISDLNTSEKGSLSLACNQETLFASNSAKEKGGAIYAKHMVLRYNGPVSFINNSAKIGGAIAIQSGGSLSLLAGEGSVLFQNNSQRTSDQGLVRNAIYLEKDAILSSLEARNGDILFFDPIVQESSSKESPLPSSLQASVTSPTPATASPLVIQTSANRSVIFSSERLSEEEKTPDNLTSQLQQPIELKSGRLVLKDRAVLSAPSLSQDPQALLIMEAGTSLKTSSDLKLATLSIPLHSLDTEKSVTLHAPNLSIQKIFLSNSGDENFYENVELLSKEQNNIPLLTLSKEQSHLHLPDGNLSSHFGYQGDWTFSWKDSDEGHSLIANWTPKNYVPHPERQSTLVANTLWNTYSDMQAVQSMINTIAHGGAYLFGTWGSAVSNLFYAHDSSGKPIDNWHHRSLGYLFGISTHSLDDHSFCLAAGQLLGKSSDSFITSTETTSYIATVQAQLATPLMKISAQACYNESIHELKTKYRSFSKEGFGSWHSVAVSGEVCASIPIVSNGSGLFSSFSIFSKLQGFSGTQDGFEESSGEIRSFSASSFRNISLPMGITFEKKSQKTRNYYYFLGAYIQDLKRDVESGPVVLLKNAVSWDAPMANLDSRAYMFRLTNQRALHRLQTLLNVSYVLRGQSHSYSLDLGTTYRF

SEQ ID NO: 88 - DNA, 2637 bp, Chlamydia trachomatis; identical to SEQ ID NO: 8

SEQ ID NO: 89 - protein, 975 aa, Chlamydia trachomatis
MNRVIELHAHYDQRQLSQSPNTNFLVHHPYLTLIPKFLLGALIVYAPYSFAEMELAISGHKQGKDRDTFTMISSCPEGTNYIINRKLILSDFSLLNKVSSGGAFRNLAGKISFLGKNSSASIHFKHININGFGAGVFSESSIEFTDLRKLVAFGSESTGGIFTAKEDISFKNNHHIAFRNNITKGNGGVIQLQGDMKGSVSFVDQRGAIIFTNNQAVTSSSMKHSGRGGAISGDFAGSRILFLNNQQITFEGNSAVHGGAIYNKNGLVEFLGNAGPLAFKENTTIANGGAIYTSNFKANQQTSPILFSQNHANKKGGAIYAQYVNLEQNQDTIRFEKNTAKEGGGAITSSQCSITAHNTIIFSDNAAGDLGGGAILLEGKKPSLTLIAHSGNIAFSGNTMLHITKKASLDRHNSILIKEAPYKIQLAANKNHSIHFFDPVMALSASSSPIQINAPEYETPFFSPKGMIVFSGANLLDDAREDVANRTSIFNQPVHLYNGTLSIENGAHLIVQSFKQTGGRISLSPGSSLALYTMNSFFHGNISSKEPLEINGLSFGVDISPSNLQAELRAGNAPLRLSGSPSIHDPEGLFYENRDTAASPYQMEILLTSDKIVDISKFTTDSLVTNKQSGFQGAWHFSWQPNTINNTKQKILRASWLPTGEYVLESNRVGRAVPNSLWSTFLLLQTASHNLGDHLCNNRSLIPTSYFGVLIGGTGAEMSTHSSEEESFISRLGATGTSIIRLTPSLTLSGGGSHMFGDSFVADLPEHITSEGIVQNVGLTHVWGPLTVNSTLCAALDHNAMVRICSKKDHTYGKWDTFGMRGTLGASYTFLEYDQTMRVFSFANIEATNILQRAFTETGYNPRSFSKTKLLNIAIPIGIGYEFCLGNSSFALLGKGSIGYSRDIKRENPSTLAHLAMNDFAWTTNGCSVPTSAHTLANQLILRYKACSLYITAYTINREGKNLSNSLSCGGYVGF

SEQ ID NO: 90 - DNA, 2928 bp, Chlamydia trachomatis; identical to SEQ ID NO: 12

SEQ ID NO: 91 - protein, 975 aa, Chlamydia trachomatis
MNRVIELHAHYDQRQLSQSPNTNFLVHHPYLTLIPKFLLGALIVYAPYSFAEMELAISGHKQGKDRDTFTMISSCPEGTNYIINRKLILSDFSLLNKVSSGGAFRNLAGKISFLGKNSSASIHFKHININGFGAGVFSESSIEFTDLRKLVAFGSESTGGIFTAKEDISFKNNHHIAFRNNITKGNGGVIQLQGDMKGSVSFVDQRGAIIFTNNQAVTSSSMKHSGRGGAISGDFAGSRILFLNNQQITFEGNSAVHGGAIYNKNGLVEFLGNAGPLAFKENTTIANGGAIYTSNFKANQQTSPILFSQNHANKKGGAIYAQYVNLEQNQDTIRFEKNTAKEGGGAITSSQCSITAHNTIIFSDNAAGDLGGGAILLEGKKPSLTLIAHSGNIAFSGNTMLHITKKASLDRHNSILLKEAPYKIQLAANKNHSIHFFDPVMALSASSSPIQINAPEYETPFFSPKGMIVFSGANLLDDAREDVANRTSIFNQPVHLYNGTLSIENGAHLIVQSFKQTGGRISLSPGSSLALYTMNSFFHGNISSKEPLEINGLSFGVDISPSNLQAELRAGNAPLRLSGSPSIHDPEGLFYENRDTAASPYQMEILLTSDKIVDISKFTTDSLVTNKQSGFQGAWHFSWQPNTINNTKQKILRASWLPTGEYVLESNRVGRAVPNSLWSTFLLLQTASHNLGDHLCNNRSLIPTSYFGVLIGGTGAEMSTHSSEEESFISRLGATGTSIIRLTPSLTLSGGGSHMFGDSFVADLPEHITSEGIVQNVGLTHVWGPLTVNSTLCAALDHNAMVRICSKKDHTYGKWDTFGMRGTLGASYTFLEYDQTMRVFSFANLEATNILQRAFTETGYNPRSFSKTKLLNIAIPIGIGYEFCLGNSSFALLGKGSIGYSRDIKRENPSTLAHLAMNDFAWTTNGCSVPTSAHTLANQLILRYKACSLYITAYTINREGKNLSNSLSCGGYVGF

SEQ ID NO: 92 - DNA, 2928 bp, Chlamydia trachomatis; identical to SEQ ID NO: 12

SEQ ID NO: 93 - protein, 1013 aa, Chlamydia trachomatis; identical to SEQ ID NO: 9

SEQ ID NO: 94 - DNA, 3042 bp, Chlamydia trachomatis; identical to SEQ ID NO: 2

SEQ ID NO: 95 - protein, 1016 aa, Chlamydia trachomatis
MPFSLRSTSFCFLACLCSYSYGFASSPQVLTPNVTTPFKGDDVYLNGDCAFVNVYAGAENGSIISANGDNLTITGQNHTLSFTDSQGPVLQNYAFISAGETLTLKDFSSLMFSKNVSCGEKGMISGKTVSISGAGEVIFWDNSVGYSPLSIVPASTPTPPAPAPAPAASSSLSPTVSDARKGSIFSVETSLEISGVKKGVMFDNNAGNFGTVFRGNSNNNAGSGGSGSATTPSFTVKNCKGKVSFTDNVASCGGGVVYKGTVLFKDNEGGIFFRGNTAYDDLGILAATSRDQNTETGGGGGVICSPDDSVKFEGNKGSIVFDYNFAKGRGGSILTKEFSLVADDSVVFSNNTAEKGGGAIYAPTIDISTNGGSILFERNRAAEGGAICVSEASSGSTGNLTLSASDGDIVFSGNMTSDRPGERSAARILSDGTTVSLNASGLSKLIFYDPVVQNNSAAGASTPSPSSSSMPGAVTINQSGNGSVIFTAESLTPSEKLQVLNSTSNFPGALTVSGGELVVTEGATLTTGTITATSGRVTLGSGASLSAVAGAANNNYTCTVSKLGIDLESFLTPNYKTAILGADGTVTVNSGSTLDLVMESEAEVYDNPLFVGSLTIPFVTLSSSSASNGVTKNSVTINDADAAHYGYQGSWSADWTKPPLAPDAKGMVPPNTNNTLYLTWRPASNYGEYRLDPQRKGELVPNSLWVAGSALRTFTNGLKEHYVSRDVGFVASLHALGDYILNYTQDDRDGFLARYGGFQATAASHYENGSIFGVAFGQLYGQTKSRMYYSKDAGNMTMLSCFGRSYVDIKGTETVMYWETAYGYSVHRMHTQYFNDKTQKFDHSKCHWHNNNYYAFVGAEHNFLEYCIPTRQFARDYELTGFMRFEMAGGWSSSTRETGSLTRYFARGSGHNMSLPIGIVAHAVSHVRRSPPSKLTLNMGYRPDIWRVTPHCNMEIIANGVKTPIQGSPLARHAFFLEVHDTLYIHHFGRAYMNYSLDARRRQTAHFVSMGLNRIF

SEQ ID NO: 96 - DNA, 3051 bp, Chlamydia trachomatis
atgcctttttctttgagatctacatcattttgttttttagcttgtttgtgttcctattcgtatggattcgcgagctctcctcaagtgttaacacctaatgtaaccactccttttaagggggacgatgtttacttgaatggagactgcgcttttgtcaatgtctatgcaggggcagagaacggctcaattatctcagctaatggcgacaatttaacgattaccggacaaaaccatacattatcatttacagattctcaagggccagttcttcaaaattatgccttcatttcagcaggagagacacttactctgaaagatttttcgagtttgatgttctcgaaaaatgtttcttgcggagaaaagggaatgatctcagggaaaaccgtgagtatttccggagcaggcgaagtgattttttgggataactctgtggggtattctcctttgtctattgtgccagcatcgactccaactcctccagcaccagcaccagctcctgctgcttcaagctctttatctccaacagttagtgatgctcggaaagggtctattttttctgtagagactagtttggagatctcaggcgtcaaaaaaggggtcatgttcgataataatgccgggaattttggaacagtttttcgaggtaatagtaataataatgctggtagtgggggtagtgggtctgctacaacaccaagttttacagttaaaaactgtaaagggaaagtttctttcacagataacgtagcctcctgtggaggcggagtagtctacaaaggaactgtgcttttcaaagacaatgaaggaggcatattcttccgagggaacacagcatacgatgatttagggattcttgctgctactagtcgggatcagaatacggagacaggaggcggtggaggagttatttgctctccagatgattctgtaaagtttgaaggcaataaaggttctattgtttttgattacaactttgcaaaaggcagaggcggaagcatcctaacgaaagaattctctcttgtagcagatgattcggttgtctttagtaacaatacagcagaaaaaggcggtggagctatttatgctcctactatcgatataagcacgaatggaggatcgattctatttgaaagaaaccgagctgcagaaggaggcgccatctgcgtgagtgaagcaagctctggttcaactggaaatcttactttaagcgcttctgatggggatattgttttttctgggaatatgacgagtgatcgtcctggagagcgcagcgcagcaagaatcttaagtgatggaacgactgtttctttaaatgcttccggactatcgaagctgatcttttatgatcctgtagtacaaaataattcagcagcgggtgcatcgacaccatcaccatcttcttcttctatgcctggtgctgtcacgattaatcagtccggtaatggatctgtgatttttaccgccgagtcattgactccttcagaaaaacttcaagttcttaactctacttctaacttcccaggagctctgactgtgtcaggaggggagttggttgtgacggaaggagctaccttaactactgggaccattacagccacctctggacgagtgactttaggatccggagcttcgttgtctgccgttgcaggtgctgcaaataataattatacttgtacagtatctaagttggggattgatttagaatcctttttaactcctaactataagacggccatactgggtgcggatggaacagttactgttaacagcggctctactttagacctagtgatggagagtgaggcagaggtatatgataatccgctttttgtgggatcgctgacaattccttttgttactctatcttctagtagtgctagtaacggagttacaaaaaattctgtcactattaatgatgcagacgctgcgcactatgggtatcaaggctcttggtctgcagattggacgaaaccgcctctggctcctgatgctaaggggatggtacctcctaataccaataacactctgtatctgacatggagacctgcttcgaattacggtgaatatcgactggatcctcagagaaagggagaactagtacccaactctctttgggtagcgggatctgcattaagaacctttactaatggtttgaaagaacactatgtttctagagatgttggatttgtagcatctctgcatgctctcggggattatattttgaattatacgcaagatgatcgggatggctttttagctagatatgggggattccaggcgaccgcagcctcccattatgaaaatgggtcaatatttggagtggcttttggacaactctatggtcagacaaagagcagaatgtattactctaaagatgctgggaacatgacgatgttgtcctgtttcggaagaagttacgtagatattaaaggaacagaaactgttatgtattgggagacggcttatggctattctgtgcacagaatgcatacgcagtattttaatgacaaaacgcagaagttcgatcattcgaaatgtcattggcacaacaataactattatgcgtttgtgggtgccgagcataatttcttagagtactgcattcctactcgtcagttcgctagagattatgagcttacagggtttatgcgttttgaaatggccggaggatggtccagttctacacgagaaactggctccctaactagatatttcgctcgcgggtcagggcataatatgtcgcttccaataggaattgtagctcatgcagtttctcatgtgcgaagatctcctccttctaaactgacactaaatatgggatatagaccagacatttggcgtgtcactccacattgcaatatggaaattattgctaacggagtgaagacacctatacaaggatctccgctggcacggcatgccttcttcttagaagtgcatgatactttgtatattcatcattttggaagagcctatatgaactattcgctggatgctcgtcgtcgacaaacggcacattttgtatccatgggcttgaatagaatcttttaa

SEQ ID NO: 97 - protein, 964 aa, Chlamydia trachomatis
MKKAFFFFLIGNSLSGLAREVPSRIFLMPNSVPDPTKESLSNKISLTGDTHNLTNCYLDNLRYLLAILQKTPNEGAAVTITDYLSFFDTQKEGIYFAKNLTPESGGAIGYASPNSPTVEIRDTIGPVLFENNTCCRLFTWRNPYAADKIREGGAIHAQNLYINHNHDVVGFMKNFSYVQGGAISTANTFVVSENQSCFLFMDNICIQTNTAGKGGAIYAGTSNSFESNNCDLFFINNACCAGGAIFSPICSLTGNRGNIVFYNNRCFKNVETASSEASDGGAIKVTTRLDVTGNRGRIFFSDNITKNYGGAIYAPVVTLVDNGPTYFINNIANNKGGAIYIDGTSNSKISADRHAIIFNENIVTNVTNANGTSTSANPPRRNAITVASSSGEILLGAGSSQNLIFYDPIEVSNAGVSVSFNKEADQTGSVVFSGATVNSADFHQRNLQTKTPAPLTLSNGFLCIEDHAQLTVNRFTQTGGVVSLGNGAVLSCYKNGTGDSASNASITLKHIGLNLSSILKSGAEIPLLWVEPTNNSNNYTADTAATFSLSDVKLSLIDDYGNSPYESTDLTHALSSQPMLSISEASDNQLQSENIDFSGLNVPHYGWQGLWTWGWAKTQDPEPASSATITDPQKANRFHRTLLLTWLPAGYVPSPKHRSPLIANTLWGNMLLATESLKNSAELTPSGHPFWGITGGGLGMMVYQDPRENHPGFHMRSSGYSAGMIAGQTHTFSLKFSQTYTKLNERYAKNNVSSKNYSCQGEMLFSLQEGFLLTKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATHRPQAWTVELAYQPVLYRQEPGIAAQLLASKGIWFGSGSPSSRHAMSYKISQQTQPLSWLTLHFQYHGFYSSSTFCNYLNGEIALRF

SEQ ID NO: 98 - DNA, 2895 bp, Chlamydia trachomatis; identical to SEQ ID NO: 16

SEQ ID NO: 99 - protein, 964 aa, Chlamydia trachomatis
MKKAFFFFLIGNSLSGLAREVPSRIFLMPNSVPDPTKESLSNKISLTGDTHNLTNCYLDNLRYILAILQKTPNEGAAVTITDYLSFFDTQKEGIYFAKNLTPESGGAIGYASPNSPTVEIRDTIGPVIFENNTCCRLFTWRNPYAADKIREGGAIHAQNLYINHNHDVVGFMKNFSYVQGGAISTANTFVVSENQSCFLFMDNICIQTNTAGKGGAIYAGTSNSFESNNCDLFFINNACCAGGAIFSPICSLTGNRGNIVFYNNRCFKNVETASSEASDGGAIKVTTRLDVTGNRGRIFFSDNITKNYGGAIYAPVVTLVDNGPTYFINNIANNKGGAIYIDGTSNSKISADRHAIIFNENIVTNVTNANGTSTSANPPRRNAITVASSSGEILLGAGSSQNLIFYDPIEVSNAGVSVSFNKEADQTGSVVFSGATVNSADFHQRNLQTKTPAPLTLSNGFLCIEDHAQLTVNRFTQTGGVVSLGNGAVLSCYKNGTGDSASNASITLKHIGLNLSSILKSGAEIPLLWVEPTNNSNNYTADTAATFSLSDVKLSLIDDYGNSPYESTDLTHALSSQPMLSISEASDNQLQSENIDFSGLNVPHYGWQGLWTWGWAKTQDPEPASSATITDPQKANRFHRTLLLTWLPAGYVPSPKHRSPLIANTLWGNMLLATESLKNSAELTPSGHPFWGITGGGLGMMVYQDPRENHPGFHMRSSGYSAGMIAGQTHTFSLKFSQTYTKLNERYAKNNVSSKNYSCQGEMLFSLQEGFLLTKLVGLYSYGDHNCHHFYTQGENLTSQGTFRSQTMGGAVFFDLPMKPFGSTHILTAPFLGALGIYSSLSHFTEVGAYPRSFSTKTPLINVLVPIGVKGSFMNATHRPQAWTVELAYQPVLYRQEPGIAAQLLASKGIWFGSGSPSSRHAMSYKISQQTQPLSWLTLHFQYHGFYSSSTFCNYLNGEIALRF

SEQ ID NO: 100 - DNA, 2895 bp, Chlamydia trachomatis; identical to SEQ ID NO: 16

SEQ ID NO: 101 - protein, 964 aa, Chlamydia trachomatis; identical to SEQ ID NO: 99

SEQ ID NO: 102 - DNA, 2895 bp, Chlamydia trachomatis; identical to SEQ ID NO: 16

SEQ ID NO: 103 - protein, 358 aa, Chlamydia trachomatis
MRKTVLVAMSGGVDSSVVAYLLKKQGEYNVVGLFMKNWGEQDENGECTATKDFRDVERLAEQLSIPYYTVSFSKEYKERVFSRFLREYANGYTPNPDVLCNREIKFDLLQKKVRELKGDFLATGHYCRGGADGTGLSRGIDPNKDQSYFLCGTPKDALSNVLFPLGGMYKTEVRRIAQEAGLATATKKDSTGICFIGKRPFKSFLEQFVADSPGDIIDFDTQQVVGRHEGAHYYTIGQRRGLNIGGMEKPCYVLSKNMEKNIVYIVRGEDHPLLYRQELLAKELNWFVPLQEPMICSAKVRYRSPDEKCSVYPLEDGTVKVIFDVPVKAVTPGQTVAFYQGDICLGGGVIEVPMIHQL

SEQ ID NO: 104 - DNA, 1077 bp, Chlamydia trachomatis
gtgcgtaaaactgtcattgttgctatgtctggaggagtggattcctcggttgttgcttatctcttaaagaagcaaggggagtataatgttgttgggctcttcatgaaaaattggggagagcaggacgagaatggtgagtgtactgcaaccaaagattttcgcgatgtagagcggatcgcagaacaattgtccattccatattacacagtttccttttctaaggaatataaagagcgagtgttttctagatttctaagagaatatgcgaacggctacactcccaatcctgatgtgttatgcaatcgagaaatcaaatttgatttattacagaagaaggtacgtgagctaaaaggtgattttttagccacgggacattattgtcgaggaggggctgatggaactggtttgtccagaggaatagaccccaataaagaccaaagttatttcttatgtggcactcctaaggatgctttatccaatgtacttttccccctgggaggtatgtataaaacggaggtacgtcgaattgctcaagaagctggtttagctaccgccacaaaaaaagatagcacagggatttgcttcattggtaaacggccttttaagagtttccttgagcagtttgtagcagactctcctggagacattattgattttgatacacaacaggtagtcggccgacatgaaggagcccattattatacgattggacagcgtcgagggttaaacataggaggaatggaaaagccttgttatgttcttagcaagaatatggaaaagaatattgtttacattgtaaggggtgaagatcatcctttactttatcgacaagagcttttagctaaggaacttaattggtttgttcccttgcaggagcctatgatctgtagtgctaaagttcggtacagatcccctgacgagaaatgttctgtatatcctttggaagatggaacggtaaaagtgattttcgatgtccctgtgaaagctgtcacccctggacagactgtagctttctaccagggggacatttgtttaggaggaggagtgattgaagtgcctatgattcatcagctgtaa

SEQ ID NO: 105 - protein, 257 aa, Chlamydia trachomatis
MCIKRKKTWIAFLAVVCSFCLTGCLKEGGDSNSEKFIVGTNATYPPFEFVDKRGEVVGFDIDLAREISNKLGKTLDVREFSFDALILNLKQHRIDAVITGMSITPSRLKEILMIPYYGEEIKHLVLVFKGENKHPLPLTQYRSVAVQTGTYQEAYLQSLSEVHIRSFDSTLEVLMEVMHGKSPVAVLEPSIAQVVLKDFPALSTATIDLPEDQWVLGYGIGVASDRPALALKIEAAVQEIRKEGVLAELEQKWGLNN

SEQ ID NO: 106 - DNA, 774 bp, Chlamydia trachomatis
atgtgcataaaaagaaaaaaaacatggatagcttttttagcagttgtctgtagtttttgtttgacgggttgtttaaaagaagggggagactccaatagtgaaaaatttattgtagggactaatgcaacctaccctccttttgagtttgttgataagcgaggagaggttgtaggcttcgatatagacttggctagagagattagtaacaagctggggaaaacgctggacgttcgggagttttcctttgatgcactcattctaaacctaaaacagcatcggattgatgcggttataacagggatgtccattactccttctagattgaaggaaattcttatgattccctattatggggaggaaataaaacacttggttttagtgtttaaaggagagaataagcatccattgccactcactcaatatcgttctgtagctgttcaaacaggaacctatcaagaggcctatttacagtctctttctgaagttcatattcgctcttttgatagcactctagaagtactcatggaagtcatgcatggtaaatctcccgtcgctgttttagagccatctatcgctcaagttgtcttgaaagatttcccggctctttctacagcaaccatagatctccctgaagatcagtgggttttaggatacgggattggcgttgcttcagatcgcccagctttagccttgaaaatcgaggcagctgtgcaagagatccgaaaagaaggagtgctagcagagttggaacagaagtggggtttgaacaactaa

SEQ ID NO: 107 - protein, 660 aa, Chlamydia trachomatis
MSEKRKSNKIIGIDLGTTNSCVSVMEGGQPKVIASSEGTRTTPSIVAFKGGETLVGIPAKRQAVTNPEKTLASTKRFIGRKFSEVESEIKTVPYKVAPNSKGDAVFDVEQKLYTPEEIGAQILMKMKETAEAYLGETVTEAVITVPAYFNDSQRASTKDAGRIAGLDVKRIIPEPTAAALAYGIDKEGDKKIAVFDLGGGTFDISILEIGDGVFEVLSTNGDTHLGGDDFDGVIINWMLDEFKKQEGIDLSKDNMALQRLKDAAEKAKIELSGVSSTEINQPFITIDANGPKHLALTLTRAQFEHLASSLIERTKQPCAQALKDAKLSASDIDDVLLVGGMSRMPAVQAVVKEIFGKEPNKGVNPDEVVAIGAAIQGGVLGGEVKDVLLLDVIPLSLGIETLGGVMTPLVERNTTIPTQKKQIFSTAADNQPAVTIVVLQGERPMAKDNKEIGRFDLTDIPPAPRGHPQIEVTFDIDANGILHVSAKDAASGREQKIRIEASSGLKEDEIQQMIRDAELHKEEDKQRKEASDVKNEADGMIFRAEKAVKDYHDKIPAELVKEIEEHIEKVRQALKEDASTTALKAASDELSTHMQKIGEAMQAQSASAAASSAANAQGGPNINSEDLKKHSFSTRPPAGGSASSTDNIEDADVEIVDKPE

SEQ ID NO: 108 - DNA, 1983 bp, Chlamydia trachomatis
atgagcgaaaaaagaaagtctaacaaaattattggtatcgacctagggacgaccaactcttgcgtctctgttatggaaggtggccaacctaaagttattgcctcttctgaaggaactcgtactactccttctatcgttgcttttaaaggtggcgaaactcttgttggaattcctgcaaaacgtcaggcagtaaccaatcctgaaaaaacattggcttctactaagcgattcatcggtagaaaattctctgaagtcgaatctgaaattaaaacagtcccctacaaagttgctcctaactcgaaaggagatgcggtctttgatgtggaacaaaaactgtacactccagaagaaatcggcgctcagatcctcatgaagatgaaggaaactgctgaggcttatctcggagaaacagtaacggaagcagtcattaccgtaccagcttactttaacgattctcaaagagcttctacaaaagatgctggacgtatcgcaggattagatgttaaacgcattattcctgaaccaacagcggccgctcttgcttatggtattgataaggaaggagataaaaaaatcgccgtcttcgacttaggaggaggaactttcgatatttctatcttggaaatcggtgacggagtttttgaagttctctcaaccaacggggatactcacttgggaggagacgacttcgatggagtcatcatcaactggatgcttgatgaattcaaaaaacaagaaggcattgatctaagcaaagataacatggctttgcaaagattgaaagatgctgctgaaaaagcaaaaatagaattgtctggtgtatcgtctactgaaatcaatcagccattcatcactatcgacgctaatggacctaaacatttggctttaactctaactcgcgctcaattcgaacacctagcttcctctctcattgagcgaaccaaacaaccttgtgctcaggctttaaaagatgctaaattgtccgcttctgacattgatgatgttcttctagttggcggaatgtccagaatgcctgcggtacaagcagttgtaaaagagatctttggtaaagagcctaataaaggcgtcaatccagatgaagttgtagcgattggagctgctattcagggtggtgtcctcggcggagaagtgaaagacgttctgttgttggatgtgattcccctctctttaggaattgagactctaggtggggtcatgactcctttggtagagagaaacactacaatccctactcagaagaagcaaatcttctctacagccgctgacaatcagccagcagtgactatcgtcgttcttcaaggtgaacggcctatggcgaaagacaataaggaaattggaagatttgatctaacagacattcctcctgctcctcgcggccatccacaaattgaggtaaccttcgatattgatgccaacggaattttacacgtttctgctaaagatgctgctagtggacgcgaacaaaaaatccgtattgaagcaagctctggattaaaagaagatgaaattcaacaaatgatccgcgatgcagagcttcataaagaggaagacaaacaacgaaaagaagcttctgatgtgaaaaatgaagccgatggaatgatctttagagccgaaaaagctgtgaaagattaccacgacaaaattcctgcagaacttgttaaagaaattgaagagcatattgagaaagtacgccaagcaatcaaagaagatgcttccacaacagctatcaaagcagcttctgatgagttgagtactcatatgcaaaaaatcggagaagctatgcaggctcaatccgcatccgcagcagcatcttctgcagcgaatgctcaaggagggccaaacattaactccgaagatctgaaaaaacatagtttcagcacacgacctccagcaggaggaagcgcctcttctacagacaacattgaagatgctgatgttgaaattgttgataaacctgagtaa

SEQ ID NO: 109 - protein, 273 aa, Chlamydia trachomatis
MLSQFQDRLNIGCVRYVNALPFSSGLSQAPGVSLLMDTPTNLVPKLLSREIDYALTSVAATFSSPLHRVSSFGLAAYKKILSVNLHATSQFFAKEAPHIAATKESLSSILLLRVLCENLWNIPFPSVTLLSSDSILTQAEHYDALLLIGDTALRHPIIPGFHTYDLAASWYDLTAKPFVFAGILSLSSTISFQLQQEFSSALNYFQNHKEDITSKAAALLKLPESLMQEYYTLCRYELSEEDFAGLEQFRDYYDRLPQQAKYPNHVRFSCAYL

SEQ ID NO: 110 - DNA, 822 bp, Chlamydia trachomatis
atgcttagtcaattccaagaccgtttaaacattggttgtgtacgctacgttaacgctttacctttttctagcggcttatcacaagctccaggcgtctccttgcttatggatacccctaccaatctggtgcctaaactcctgtcacgagaaatagattatgcgttaacctctgtagcagcaacattctcttctcccttacacagagtatcttcctttgggatcgcggcttataaaaaaatcctaagcgtaaacttacatgctacttcgcaattttttgctaaggaagctcctcatatagcggctactaaagagagtctttcttctattttgctgctacgagttctatgcgaaaacctatggaatattccgttcccttccgttaccctactttcctcggacagcattcttacacaagctgaacactatgatgctttattattgataggagatacggcattacgccatcctataatcccaggattccacacttatgacctagcagcttcttggtatgacctgactgcaaaaccttttgtttttgctgggattctcagcctttcttcaactatttcatttcagcttcaacaggagttctcttccgcattgaattattttcagaatcataaagaagatattaccagcaaagcagctgcattactaaaactcccagaatcgcttatgcaagaatactatactttatgtcgctatgagctttctgaagaggattttgcagggttagaacagtttagagactattatgaccgacttccacaacaagccaaatatccaaatcatgttcgattctcttgcgcctacctatga

SEQ ID NO: 111 - protein, 254 aa, Chlamydia trachomatis
MHDALQSLLAIQELDIKMIRLMRVKKEHQNELAKIQALKTDIRRKVEEKEQEMEKLKDQIKGGEKRIQEISDQINKLENQQAAVKKMDEFNALTQEMTAANKERRTLEHQLSDLMDKQAGSEDLLISLKESLSSTENSSSAIEEELRENIRKINEEGRSLLSQRTQLKETTDPELFSIYERLLNNKKDRVVVPIENRVCSGCHIALTPQHENLVRKQDHLVFCEHCSRILYWQELQSPSAEGATTKRRRRRTAV

SEQ ID NO: 112 - DNA, 765 bp, Chlamydia trachomatis; identical to SEQ ID NO: 22

SEQ ID NO: 113 - protein, 975 aa, Chlamydia trachomatis
MNRVIELHAHYDQRQLSQSPNTNFLVHHPYLTLIPKFLLGALIVYAPYSFAEMELAISGHKQGKDRDTFTMISSCPEGTNYIINRKLILSDFSLLNKVSSGGAFRNLAGKISFLGKNSSASIHFKHININGFGAGVFSESSIEFTDLRKLVAFGSESTGGIFTAKEDISFKNNHHIAFRNNITKGNGGVIQLQGDMKGSVSFVDQRGAIIFTNNQAVTSSSMKHSGRGGAISGDFAGSRILFLNNQQITFEGNSAVHGGAIYNKNGLVEFLGNAGPLAFKENTTIANGGAIYTSNFKANQQTSPILFSQNHANKKGGAIYAQYVNLEQNQDTIRFEKNTAKEGGGAITSSQCSITAHNTIIFSDNAAGDLGGGAILLEGKKPSLTLIAHSGNIAFSGNTMLHITKKASLDRHNSILIKEAPYKIQLAANKNHSIHFFDPVMALSASSSPIQINAPEYETPFFSPKGMIVFSGANLLDDAREDVANRTSIFNQPVHLYNGTLSIENGAHLIVQSFKQTGGRISLSPGSSLALYTMNSFFHGNISSKEPLEINGLSFGVDISPSNLQAELRAGNAPLRLSGSPSIHDPEGLFYENRDTAASPYQMEILLTSDKIVDISKFTTDSLVTNKQSGFQGAWHFSWQPNTINNTKQKILRASWLPTGEYVLESNRVGRAVPNSLWSTFLLLQTASHNLGDHLCNNRSLIPTSYFGVLIGGTGAEMSTHSSEEESFISRLGATGTSIIRLTPSLTLSGGGSHMFGDSFVADLPEHITSEGIVQNVGLTHVWGPLTVNSTLCAALDHNAMVRICSKKDHTYGKWDTFGMRGTLGASYTFLEYDQTMRVFSFANLEATNILQRAFTETGYNPRSFSKTKLLNIAIPIGIGYEFCLGNSSFALLGKGSIGYSRDIKRENPSTLAHLAMNDFAWTTNGCSVPTSAHTLANQLILRYKACSLYITAYTINREGKNLSNSLSCGGYVGF

SEQ ID NO: 114 - DNA, 2928 bp, Chlamydia trachomatis; identical to SEQ ID NO: 12

SEQ ID NO: 115 - protein, 1751 aa, Chlamydia trachomatis
MKWLSATAVFAAVLPSVSGFCFPEPKELNFSRVGTSSSTTFTETVGEAGAEYIVSGNASFTKFTNIPTTDTTTPTNSNSSSSNGETASVSEDSDSTTTTPDPKGGGAFYNAHSGVLSFMTRSGTEGSLTLSEIKITGEGGAIFSQGELLFTDLTGLTIQNNLSQLSGGAIFGESTISLSGITKATFSSNSAEVPAPVKKPTEPKAQTASETSGSSSSSGNDSVSSPSSSRAEPAAANLQSHFICATATPAAQTDTETSTPSHKPGSGGAIYAKGDLTIADSQEVLFSINKATKDGGAIFAEKDVSFENITSLKVQTNGAEEKGGAIYAKGDLSIQSSKQSLFNSNYSKQGGGALYVEGDINFQDLEEIRIKYNKAGTFETKKITLPKAQASAGNADAWASSSPQSGSGATTVSNSGDSSSGSDSDTSETVPATAKGGGLYTDKNLSITNITGIIEIANNKATDVGGGAYVKGTLTCENSHRLQFLKNSSDKQGGGIYGEDNITLSNLTGKTLFQENTAKEEGGGLFIKGTDKALTMTGLDSFCLINNTSEKHGGGAFVTKEISQTYTSDVETIPGITPVHGETVITGNKSTGGNGGGVCTKRLALSNLQSISISGNSAAENGGGAHTCPDSFPTADTAEQPAAASAATSTPESAPVVSTALSTPSSSTVSSLTLLAASSQASPATSNKETQDPNADTDLLIDYVVDTTISKNTAKKGGGIYAKKAKMSRIDQLNISENSATEIGGGICCKESLELDALVSLSVTENLVGKEGGGLHAKTVNISNLKSGFSFSNNKANSSSTGVATTASAPAAAAASLQAAAAAVPSSPATPTYSGVVGGAIYGEKVTFSQCSGTCQFSGNQAIDNNPSQSSLNVQGGAIYAKTSLSIGSSDAGTSYIFSGNSVSTGKSQTTGQIAGGAIYSPTVTLNCPATFSNNTASMATPKTSSEDGSSGNSIKDTIGGAIAGTAITLSGVSRFSGNTADLGAAIGTLANANTPSATSGSQNSITEKITLENGSFIFERNQANKRGAIYSPSVSIKGNNITFNQNTSTHDGSAIYFTKDATIESLGSVLFTGNNVTATQASSATSGQNTNTANYGAAIFGDPGTTQSSQTDAILTLLASSGNITFSNNSLQNNQGDTPASKFCSIAGYVKLSLQAAKGKTISFFDCVHTSTKKIGSTQNVYETLDINKEENSNPYTGTIVFSSELHENKSYIPQNAILHNGTLVLKEKTELHVVSFEQKEGSKLIMKPGAVLSNQNIANGALVINGLTIDLSSMGTPQAGEIFSPPELRIVATTSSASGGSGVSSSIPTNPKRISAAAPSGSAATTPTMSENKVFLTGDLTLIDPNGNFYQNPMLGSDLDVPLIKLPTNTSDVQVYDLTLSGDLFPQKGYMGTWTLDSNPQTGKLQARWTFDTYRRWVYIPRDNHFYANSILGSQNSMIVVKQGLINNMLNNARFDDIAYNNFWVSGVGTFLAQQGTPLSEEFSYYSRGTSVAIDAKPRQDFILGAAFSKMVGKTKAIKKMHNYFHKGSEYSYQASVYGGKFLYFLLNKQHGWALPFLIQGVVSYGHIKHDTTTLYPSIHERNKGDWEDLGWLADLRISMDLKEPSKDSSKRITVYGELEYSSIRQKQFTEIDYDPRHFDDCAYRNLSLPVGCAVEGAIMNCNILMYNKLALAYMPSIYRNNPVCKYRVLSSNEAGQVICGVPTRTSARAEYSTQLYLGPFWTLYGNYTIDVGMYTLSQMTSCGARMIF

SEQ ID NO: 116 - DNA, 5256 bp, Chlamydia trachomatis
atgaaatggctgtcagctactgcggtgtttgctgctgttctcccctcagtttcagggttttgcttcccagaacctaaagaattaaatttctctcgcgtaggaacttcttcctctaccacttttactgaaacagttggagaagctggggcagaatatatcgtctctggtaacgcatctttcacaaaatttaccaacattcctactaccgatacaacaactcccacgaactcaaactcctctagctctaacggagagactgcttccgtttctgaggatagtgactctacaacaacgactcctgatcctaaaggtggcggcgccttttataacgcgcactccggagttttatcctttatgacacgatcaggaacagaaggttccttaactctgtctgagataaaaataactggtgaaggcggtgctatcttctctcaaggagagctgctatttacagatctgacaggtctaaccatccaaaataacttatcccagctatccggaggagcgatttttggagaatctacaatctccctatcagggattactaaagcgactttctcctccaactctgcagaagttcctgctcctgttaagaaacctacagaacctaaagctcaaacagcaagcgaaacgtcgggttctagtagttctagcggaaatgattcggtgtcttcccccagttccagtagagctgaacccgcagcagctaatcttcaaagtcactttatttgtgctacagctactcctgctgctcaaaccgatacagaaacatcaactccctctcataagccaggatctgggggagctatctatgctaaaggcgaccttactatcgcagactctcaagaggtactattctcaataaataaagctactaaagatggaggagcgatctttgctgagaaagatgtttctttcgagaatattacatcattaaaagtacaaactaacggtgctgaagaaaagggaggagctatctatgctaaaggtgacctctcaattcaatcttctaaacagagtctttttaattctaactacagtaaacaaggtggtggggctctatatgttgaaggagatataaacttccaagatcttgaagaaattcgcattaagtacaataaagctggaacgttcgaaacaaaaaaaatcactttaccaaaagctcaagcatctgcaggaaatgcagatgcttgggcctcttcctctcctcaatctggttctggagcaactacagtctccaactcaggagactctagctctggctcagactcggatacctcagaaacagttccagccacagctaaaggcggtgggctttatactgataagaatctttcgattactaacatcacaggaattatcgaaattgcaaataacaaagcgacagatgttggaggtggtgcttacgtaaaaggaacccttacttgtgaaaactctcaccgtctacaatttttgaaaaactcttccgataaacaaggtggaggaatctacggagaagacaacatcaccctatctaatttgacagggaagactctattccaagagaatactgccaaagaagagggcggtggactcttcataaaaggtacagataaagctcttacaatgacaggactggatagtttctgtttaattaataacacatcagaaaaacatggtggtggagcctttgttaccaaagaaatctctcagacttacacctctgatgtggaaacaattccaggaatcacgcctgtacatggtgaaacagtcattactggcaataaatctacaggaggtaatggtggaggcgtgtgtacaaaacgtcttgccttatctaaccttcaaagcatttctatatccgggaattctgcagctgaaaatggtggtggagcccacacatgcccagatagcttcccaacggcggatactgcagaacagcccgcagcagcttctgccgcgacgtctactcccgagtctgccccagtggtctcaactgctctaagcacaccttcatcttctaccgtctcttcattaaccttactagcagcctcttcacaagcctctcctgcaacctctaataaggaaactcaagatcctaatgctgatacagacttattgatcgattatgtagttgatacgactatcagcaaaaacactgctaagaaaggcggtggaatctatgctaaaaaagccaagatgtcccgcatagaccaactgaatatctctgagaactccgctacagagataggtggaggtatctgctgtaaagaatctttagaactagatgccctagtctccttatctgtaacagagaaccttgttgggaaagaaggtggaggcttacatgctaaaactgtaaatatttctaatctgaaatcaggcttctctttctcgaacaacaaagcaaactcctcatccacaggagtcgcaacaacagcttcagcacctgctgcagctgctgcttccctacaagcagccgcagcagccgtaccatcatctccagcaacaccaacttattcaggtgtagtaggaggagctatctatggagaaaaggttacattctctcaatgtagcgggacttgtcagttctctgggaaccaagctatcgataacaatccctcccaatcatcgttgaacgtacaaggaggagccatctatgccaaaacctctttgtctattggatcttccgatgctggaacctcctatattttctcggggaacagtgtctccactgggaaatctcaaacaacagggcaaatagcgggaggagcgatctactcccctactgttacattgaattgtcctgcgacattctctaacaatacagcctctatggctacaccaaagacttcttctgaagatggatcctcaggaaattctattaaagataccattggaggagccattgcagggacagccattaccctatctggagtctctcgattttcagggaatacggctgatttaggagctgcaataggaactctagctaatgcaaatacacccagtgcaactagcggatctcaaaatagcattacagaaaaaattactttagaaaacggttcttttatttttgaaagaaaccaagctaataaacgtggagcgatttactctcctagcgtttccattaaagggaataatattaccttcaatcaaaatacatccactcatgatggaagtgctatctactttacaaaagatgctacgattgagtctttaggatctgttctttttacaggaaataacgttacagctacacaagctagttctgcaacatctggacaaaatacaaatactgccaactatggggcagccatctttggagatccaggaaccactcaatcgtctcaaacagatgccattttaacccttcttgcttcttctggaaacattacttttagcaacaacagtttacagaataaccaaggtgatactcccgctagcaagttttgtagtattgcaggatacgtcaaactctctctacaagccgctaaagggaagactattagctttttcgattgtgtgcacacctctaccaaaaaaataggttcaacacaaaacgtttatgaaactttagatattaataaagaagagaacagtaatccatatacaggaactattgtgttctcttctgaattacatgaaaacaaatcttacatcccacagaatgcaatccttcacaacggaactttagttcttaaagagaaaacagaactccacgtagtctcttttgagcagaaagaagggtctaaattaattatgaaacccggagctgtgttatctaaccaaaacatagctaacggagctctagttatcaatgggttaacgattgatctttccagtatggggactcctcaagcaggggaaatcttctctcctccagaattacgtatcgttgccacgacctctagtgcatccggaggaagcggggtcagcagtagtataccaacaaatcctaaaaggatttctgcagcagcgccttcaggttctgccgcaactactccaactatgagcgagaacaaagttttcctaacaggagaccttactttaatagatcctaatggaaacttttaccaaaaccctatgttaggaagcgatctagatgtaccactaattaagcttccgactaacacaagtgacgtccaagtctatgatttaactttatctggggatcttttccctcagaaagggtacatgggaacctggacattagattctaatccacaaacagggaaacttcaagccagatggacattcgatacctatcgtcgctgggtatacatacctagggataatcatttttatgcgaactctatcttaggctcccaaaactcaatgattgttgtgaagcaagggcttatcaacaacatgttgaataatgcccgcttcgatgatatcgcttacaataacttctgggtttcaggagtaggaactttcttagctcaacaaggaactcctctttccgaagaattcagttactacagccgcggaacttcagttgccatcgatgccaaacctagacaagattttatcctaggagctgcatttagtaagatggtggggaaaaccaaagccatcaaaaaaatgcataattacttccataagggctctgagtactcttaccaagcttctgtctatggaggtaaattcctgtatttcttgctcaataagcaacatggttgggcacttcctttcctaatacaaggagtcgtgtcctatggacatattaaacatgatacaacaacactttacccttctatccatgaaagaaataaaggagattgggaagatttaggatggttagcggatcttcgtatctctatggatcttaaagaaccttctaaagattcttctaaacggatcactgtctatggggaacttgagtattccagcattcgccagaaacagttcacagaaatcgattacgatccaagacacttcgatgattgtgcttacagaaatctgtcgcttcctgtgggatgcgctgtcgaaggagctatcatgaactgtaatattcttatgtataataagcttgcattagcctacatgccttctatctacagaaataatcctgtctgtaaatatcgggtattgtcttcgaatgaagctggtcaagttatctgcggagtgccaactagaacctctgctagagcagaatacagtactcaactatatcttggtcccttctggactctctacggaaactatactatcgatgtaggcatgtatacgctatcgcaaatgactagctgcggtgctcgcatgatcttctaa

SEQ ID NO: 117 - protein, 276 aa, Chlamydia trachomatis
MRLLFLLLFSLGITCSYGDEVSTRKQILVSIVPYKFLVEQIAGDTCQVFSIVMDNHDPHNYELSPKYIEKIRQVELWFKIGEGFEKTCERIISCKQVDLAANIDKITNGACCQRFLSFDTHTWLSPKNLKIQIQAITEALVETAPEHETLYRKNCSLLQSQLDLLDQKISSIVSSTSQRNVLVTHGAFAYFCRDYGFIQHTIERANHSELSPKDVVRVERTIRDHNLHSVILLKHAGKRSSAALVRKFNMTPILLDPYAEDVFNNLLAIATAFANL

SEQ ID NO: 118 - DNA, 831 bp, Chlamydia trachomatis
atgcgtttactctttttactcctcttttctttggggatcacttgttcctatggagacgaggtttctactcgcaagcagattttggtcagcattgtcccctataaatttcttgtggaacaaatcgcgggggatacctgtcaggtgttctctattgttatggataaccatgaccctcataactatgagctttcgcctaaatatatagaaaagatccgccaggttgaactttggtttaaaattggtgagggatttgaaaaaacttgtgagagaattatttcgtgcaagcaagtagatctagcagcaaatatcgataaaattacaaatggggcctgctgccagcgttttcttagttttgatacccacacctggttaagtcctaaaaacctaaaaattcaaatccaggccattacagaagctttagtggagaccgcccctgaacacgaaactctgtaccgtaaaaactgttctctattacagtctcaactagatcttttggatcaaaagatttcttctattgtttctagtacatcacaacgcaatgttctagttacccacggagcttttgcttatttttgtagagattacggctttatacaacatactatcgagcgagctaaccactcagagttatctcctaaagatgttgttcgtgtagagcgaaccattcgtgatcacaacttgcactctgtaattttgctcaagcatgcggggaaacgtagtagcgccgccttagtacggaagtttaatatgacgcctattctattggatccctatgctgaagatgtcttcaataatttactagctatcgcaacggcttttgcaaatctatga

SEQ ID NO: 119 - protein, 293 aa, Chlamydia trachomatis
MPMISILCSLFPPLLFPSLLAAFGASLAAGIIGSYIVVKRIVSISGSIAHSILGGVGIALWLQYQFNLPISPLHGAIASAIFVAICIGNVHLKYHEREDSIISMIWSIGMAIGIICISKLPSFNSELSDFLFGNILWVTPQDLYFLGILDLFIVATVSICHTRFLALCFDEKYMALNHYSIKTWYLLLLILTAITTVVLMYVMGVILMLSMLVLPVSIACRFSYKMSHIIYIASILNIVCSFLGIMLAYLLDLPVGPVIAILMGGAYSLSLLLKRSYNASTPSPVSPESKINS

SEQ ID NO: 120 - DNA, 882 bp, Chlamydia trachomatis
atgcccatgatctctattctctgttctttgttcccgcctcttctattcccttcgctgctggcggctttcggcgcctccattgctgcaggaatcataggctcttatattgtagtgaaacgcattgtgtcgattagtggaagcatagcacattccattctaggaggagttggtatcgccctatggcttcaataccaatttaatctccctatatccccactacacggggctattgctagtgctatcttcgtagcgatctgtattgggaatgtccatcttaaataccatgaacgcgaagactccatcatttctatgatctggtccattggtatggctataggcattatatgtatatctaagctcccttcctttaactcagagctttctgattttctttttggcaatatcttatgggtcaccccacaagatctttatttccttgggatcctagatctgtttatcgttgctaccgtatccatttgtcacacacgattcttagccctatgcttcgatgagaaatacatggcgttgaatcattactccataaaaacttggtacctattgctgcttatcttaacagcaattacgactgttgttcttatgtatgtcatgggagttattctaatgttgagcatgttagtcctcccagtatcaatagcctgtcgtttctcctacaaaatgagccacatcatttacatcgcatctatcttaaatatcgtctgctcattcctaggaattatgcttgcttatctcctagacttgccagttgggcctgtcatagcgattctcatgggaggagcttactcactgagtttactcttgaagagatcatacaatgcatctaccccttctcctgtcagccctgaaagcaaaataaattcttga

SEQ ID NO: 121 - protein, 644 aa, Chlamydia trachomatis
MMRFARFCLLVLTLFPQLAFSAEPLRRQDVRKTVDKLVEHHIDTQQISPYILSRSLEDYVRSFDSHKAYLTQDEVFSHAFSEEATRPLFKQYQEDNFSSFKELDTCIQQSISRAREWRSSWLTDSIRVIQDAMSHTIEKKPSAWASSIEEVKQRQYDLLLSYASIYLEDAAKNRYQGKEHALVKLCIRQIENHENPYIGINDHGYRMSPEEEANSFHVRIIKSIAHSLDAHTAYFSQEEALSMRAQLEKGMCGIGVVLKEDIDGVVVKEVLAGGPADKTGSLRVGDIIYRVNGKNIENTPFPGVLDSLRGSPGSSVTLDIHRQNNDHVIQLRREKILLDSRRVDVSYEPYGNGIIGKITLHSFYEGENQVSSEQDLRKAIRELQEKNLLGLVLDLRENTGGFLSQAIKVSGLFLTNGVVVVSRYADGSVKRYRTISPQKFYDGPLAVLVSKSSASAAEIVAQTLQDYGVALIVGDQQTYGKGTIQHQTITGSNSQEDFFKVTVGRYYSPSGKSTQLEGVKSDIVIPSRYAEDKLGERFLEYALPADQYENVINDNLGDLDINIRPWFQKYYSPHLQKPELVWREMLPQLAHNSQERLEKNKNFEIFVQHLKKTNKQDRSFGSNDLQMEESVNIVKDMILLKSIS

SEQ ID NO: 122 - DNA, 1935 bp, Chlamydia trachomatis
atgatgagattcgctcgcttttgtctgctagttttaaccctatttccacaacttgcgttttcagcagagcctcttcgacgacaagatgtccgcaaaaccgtagataaactagtcgaacatcatattgatacgcaacagatctctccttacattctctctcgatctttggaagattatgttcgttcttttgattctcacaaagcgtaccttactcaagacgaggtcttctcccacgctttttcagaagaagcaacacgtcccctatttaagcaatatcaagaagataacttttcttctttcaaggaattagatacctgtatccaacaaagtatttctcgagccagagaatggcgctcatcctggctcactgattccataagagtaattcaagatgccatgtctcatactattgagaaaaaaccaagcgcttgggcttcttcaattgaagaagtaaagcaaagacaatacgatcttcttctttcctacgcatctatctatttagaagatgcagcaaaaaatcgttatcaagggaaagaacatgctttagttaaactctgtatccgccagattgaaaaccatgaaaatccttatatcggcattaacgatcatggatacagaatgtctccagaggaagaggccaatagcttccatgttcgtattatcaaatctattgctcacagcctagatgcgcataccgcctactttagtcaggaagaagctctatccatgagagctcagctggagaaaggcatgtgtggcataggagtcgtgcttaaagaagatattgatggggttgtggttaaagaagtccttgctggaggccctgctgataaaacgggtagccttcgtgtaggtgatattatttaccgtgtaaatgggaaaaatattgaaaacacccctttccccggggttttagattctctaagaggttctccaggatcctccgttactttagatatccacagacaaaataatgaccacgtcattcagttacgtcgtgaaaaaattctcttagatagtcgtcgtgtcgacgtgtcttacgagccgtacggtaatggcattatcggtaagatcaccttgcactctttctatgaaggagaaaaccaagtatcgagcgaacaagatctacgtaaagccattcgagaattacaagaaaaaaacctgcttggcttagttcttgatattcgagagaatacgggaggatttttatctcaagccatcaaagtgtctgggttatttttaacgaatggggttgtggttgtctcccgctatgcagatggttcggtaaaacgctaccgcactatttctcctcaaaaattttatgatgggccgctagctgttttggtttctaaaagttccgcttcggcagcagaaattgttgcacaaacactccaggattacggagtagccctgatcgtgggagatcaacaaacttatggaaaaggaaccatccaacatcagactatcactggaagcaacagtcaagaagatttctttaaagtgacagtggggagatattactctccttcgggaaaatccacacaactcgaaggagtgaaatcagacattgttatcccctcacgttatgcagaagataaactcggagaacgctttttagagtatgctctaccagctgatcaatacgaaaatgtgatcaatgacaacctgggagacctagatatcaacatccgtccttggtttcaaaaatactattctccacatttacaaaaaccagaactggtttggagagaaatgcttcctcagcttgctcacaatagccaagaacgtcttgaaaaaaacaaaaactttgagatttttgtccaacacttgaaaaaaacaaacaaacaggatcgatcgtttggaagcaacgatctgcaaatggaagaaagtgtgaacatcgttaaggatatgatccttctaaaatctatatcataa

SEQ ID NO: 123 - protein, 150 aa, Chlamydia trachomatis
MSTVPVVQGAGSSNSAQDISTRPLTLKERISNLLSSTAFKVGLVVIGLLLVIATLIFLVSAASFVNAIYLVAIPAILGCVNICVGILSMEGHCSPERWILCKKVLKTSEDIIDDGQINNSNKVFTDERLNAIGGVVESLSRRNSLVDQTQ

SEQ ID NO: 124 - DNA, 453 bp, Chlamydia trachomatis
atgagcactgtacccgttgttcaaggagctggatcttccaattcggcacaggatatttccactagaccattaacactgaaagagcgtatatcgaatcttctatcttccactgcatttaaggtgggattagtggtgataggactacttttagtgattgctactttgatattcctagtttcggcagcttcgtttgtaaatgccatctatctagtagctattcctgctattttgggatgcgtgaatatctgcgtaggaattttatccatggaaggacactgttctccggagagatggatcttatgtaagaaggtattaaagacttcagaagatatcatcgatgatgggcagataaacaactctaataaagtgtttactgatgagaggttgaatgccataggtggggtagtggaatctctatctagaagaaatagtctggtggatcagacccaatga

SEQ ID NO: 125 - protein, 553 aa, Chlamydia trachomatis
MRIGDPMNKLIRRAVTIFAVTSVASLFASGVLETSMAESLSTNVISLADTKAKDNTSHKSKKARKNHSKETPVDRKEVAPVHESKATGPKQDSCFGRMYTVKVNDDRNVEITQAVPEYATVGSPYPIEITATGKRDCVDVIITQQLPCEAEFVRSDPATTPTADGKLVWKIDRLGQGEKSKITVWVKPLKEGCCFTAATVCACPEIRSVTKCGQPAICVKQEGPENACLRCPVVYKINIVNQGTATARNVVVENPVPDGYAHSSGQRVLTFTLGDMQPGEHRTITVEFCPLKRGRATNIATVSYCGGHKNTASVTTVINEPCVQVSIAGADWSYVCKPVEYVISVSNPGDLVLRDVVVEDTLSPGVTVLEAAGAQISCNKVVWTVKELNPGESLQYKVLVRAQTPGQFTNNVVVKSCSDCGTCTSCAEATTYWKGVAATHMCVVDTCDPVCVGENTVYRICVTNRGSAEDTNVSLMLKFSKELQPVSFSGPTKGTITGNTVVFDSLPRLGSKETVEFSVTLKAVSAGDARGEAILSSDTLTVPVSDTENTHIY

SEQ ID NO: 126 - DNA, 1662 bp, Chlamydia trachomatis
atgcgaataggagatcctatgaacaaactcatcagacgagcagtgacgatcttcgcggtgactagtgtggcgagtttatttgctagcggggtgttagagacctctatggcagagtctctctctacaaacgttattagcttagctgacaccaaagcgaaagacaacacttctcataaaagcaaaaaagcaagaaaaaaccacagcaaagagactcccgtagaccgtaaagaggttgctccggttcatgagtctaaagctacaggacctaaacaggattcttgctttggcagaatgtatacagtcaaagttaatgatgatcgcaatgttgaaatcacacaagctgttcctgaatatgctacggtaggatctccctatcctattgaaattactgctacaggtaaaagggattgtgttgatgttatcattactcagcaattaccatgtgaagcagagttcgtacgcagtgatccagcgacaactcctactgctgatggtaagctagtttggaaaattgaccgcttaggacaaggcgaaaagagtaaaattactgtatgggtaaaacctcttaaagaaggttgctgctttacagctgcaacagtatgcgcttgtccagagatccgttcggttacaaaatgtggacaacctgctatctgtgttaaacaagaaggcccagagaatgcttgtttgcgttgcccagtagtttacaaaattaatatagtgaaccaaggaacagcaacagctcgtaacgttgttgttgaaaatcctgttccagatggttacgctcattcttctggacagcgtgtactgacgtttactcttggagatatgcaacctggagagcacagaacaattactgtagagttttgtccgcttaaacgtggtcgtgctaccaatatagcaacggtttcttactgtggaggacataaaaatacagcaagcgtaacaactgtgatcaacgagccttgcgtacaagtaagtattgcaggagcagattggtcttatgtttgtaagcctgtagaatatgtgatctccgtttccaatcctggagatcttgtgttgcgagatgtcgtcgttgaagacactctttctcccggagtcacagttcttgaagctgcaggagctcaaatttcttgtaataaagtagtttggactgtgaaagaactgaatcctggagagtctctacagtataaagttctagtaagagcacaaactcctggacaattcacaaataatgttgttgtgaagagctgctctgactgtggtacttgtacttcttgcgcagaagcgacaacttactggaaaggagttgctgctactcatatgtgcgtagtagatacttgtgaccctgtttgtgtaggagaaaatactgtttaccgtatttgtgtcaccaacagaggttctgcagaagatacaaatgtttctttaatgcttaaattctctaaagaactgcaacctgtatccttctctggaccaactaaaggaacgattacaggcaatacagtagtattcgattcgttacctagattaggttctaaagaaactgtagagttttctgtaacattgaaagcagtatcagctggagatgctcgtggggaagcgattctttcttccgatacattgactgttccagtttctgatacagagaatacacacatctattaa

SEQ ID NO: 127 - protein, 88 aa, Chlamydia trachomatis
MKKTALLAALCSVVSLSSCCRIVDCCFEDPCAPIQCSPCESKKKDVDGGCNSCNGYVPACKPCGGDTHQDAKHGPQARGIPVDGKCRQ

SEQ ID NO: 128 - DNA, 267 bp, Chlamydia trachomatis
atgaaaaaaactgctttactcgctgctttatgtagtgttgtttctttaagtagttgttgtcgtatcgttgactgttgcttcgaagatccatgcgcacctatccaatgttcaccttgtgaatctaagaagaaagacgtagacggtggttgcaactcttgtaacgggtatgtcccagcttgcaaaccttgcggaggggatacgcaccaagatgctaaacatggccctcaagctagaggaattccagttgacggcaaatgcagacaatag

SEQ ID NO: 129 - protein, 352 aa, Chlamydia trachomatis
MPKIDTCDSCVSNTELLAIRTRVTQSYNEAQTILSSIPDGIFLLSESGEILICNPQARAILGIPEDIQLVTRMFHDFFPDTFFGFSVQEALEKEVPPKTIRLTLSQELSQKEVEVFVRKNISHDFLFLLIRDRSDYRQLEQAIEKYRSISELGKLAATLAHEIRNPLTSISGFATLLKEELSSERHQRMLNVIIEGTRSLNSLVSSMLEYTKIQPLNLRSIDLQDFFSSLIPELSLTFPSCTFRRTILSPIQRSIDPDRLRCVIWNLVKNAVEASDEEIFLELHEKGFSVINTGTLPPNIQEKLFIPFFTTKPQGNGLGLAEAHKIMRLHGGDLVVSTQDNRTTFTILWTPA

SEQ ID NO: 130 - DNA, 1059 bp, Chlamydia trachomatis
atgccaaaaatcgacacttgtgattcttgcgtttccaataccgaacttttggccattcgtacgcgagtaacacaatcgtataacgaagctcaaaccatcctatcttcgattcccgatggcatttttctactttctgaatctggagagattctgatttgcaatccccaagcccgcgctattttaggcatccctgaggacatccagctggtcacacggatgttccatgattttttccccgatactttttttggattctcagtacaagaagctttagaaaaagaagtccctcctaaaacgattcgactaaccctatctcaagaactctcccaaaaagaggtagaagtttttgttaggaaaaatatctctcacgacttcctcttccttctcatccgcgaccggtcggactataggcaattagaacaagcgattgaaaaataccgcagcatttccgagttagggaaaatagctgcaactctagcacatgaaatccgtaatcctctaactagtatttcaggattcgcaaccttactgaaagaagagctctcttcagaacgccaccaacgcatgctcaatgtcatcatagaaggtactcgctcattaaattctcttgtttcttctatgcttgaatatacaaaaattcaacctctgaaccttcgttctatagacctacaggatttcttttcttctctcattccagaactctctttaacctttccttcttgtacatttagaagaaccatcttatctcctatacagcgctctatagatcctgatcgcttgcgatgtgtgatatggaaccttgtaaaaaatgccgtcgaagcatcggatgaagaaatctttctagaactacatgaaaaagggttttccgttatcaataccggcactcttcctcctaatatccaagaaaagctttttattcctttcttcactacgaaacctcaagggaacggtctaggcctagcagaggctcataaaatcatgcgcctgcatggcggagatctggttgtttcaacccaggataatcgtactacctttaccatcctatggactcccgcttaa

SEQ ID NO: 131 - protein, 367 aa, Chlamydia trachomatis
MFTSLSAIQNAIRPSCQLPVLTPRRALITSLASGIILGLAGCVVGVLASFPALIAVSAVILGVSLFASGLFLCRYVCPPKIVSRRPSTELPAEPTPELPEIKRPKPIAPPPPDFIPPRPLRRTIGEMLFGWNCIGSIRQMPFFLANDKTPLSFRNPSARFRAWNIPSTHTIFVSTSGQFSSLRMQSNLPAAIANATQSAAFAKRGQGGLGVNDAFPAVLTDKCWEESKPDSGILLPGECSSATWEDKNHLVPCWDEETKTYNKPLLFIQMLAPKASMYQDDSKSCYEITLRAYTACFEEAIRCGCRIIQIPLLAAFGDFVPRALSKQPKWIESAKLSLLHAVEKTAKKHASKDLVIVLTNIPQPVNL

SEQ ID NO: 132 - DNA, 1104 bp, Chlamydia trachomatis
atgtttacgtcgctgtccgcaatacagaatgctatacgtccttcttgtcaacttcctgttttgactcctagacgcgctctcattacttctcttgcgtctggaatcattttaggacttgctggttgcgtggttggcgttttagcctcctttcctgccctaatcgccgtttctgctgttattttaggtgtcagtctttttgcttcaggactatttctctgtcgatatgtttgtcccccaaaaattgtgtcccgaagaccttctaccgaactccctgctgaacctactcccgagctgcctgaaatcaaaagacctaaacctatagctcctcctcctccagatttcatacctccaagaccactgagaagaacgatcggtgaaatgctttttggatggaactgcataggatcgataagacagatgccgtttttccttgctaatgacaaaacgcctctgtccttcagaaatccttcagcaagatttagagcctggaatattccttccactcatactatttttgtctctacttcaggccaattttcttctttgagaatgcaatcgaatctacctgctgcgattgcaaatgccacgcaatcggcagccttcgcgaagagaggccaaggaggattaggagtgaacgatgcattccctgctgtgcttaccgacaagtgctgggaagaatcgaaacccgactcaggcatcctacttccaggagaatgctcttctgccacctgggaagacaaaaatcatctagtgccttgctgggatgaggaaacaaagacctataacaagcctctattgttcatccaaatgctagctcctaaagcttctatgtatcaagatgactctaaatcttgctatgagataaccttacgagcttacacagcttgtttcgaagaggctattcgttgtggttgtcgtataatccaaattcctttaatcgctgctttcggagattttgttccaagagcgctaagcaaacagccaaaatggatcgagtctgctaaactatccttactccatgccgtagaaaaaaccgcgaaaaaacacgcatccaaagatctagtgattgttttaacgaacatccctcaacccgtgaatttataa

SEQ ID NO: 133 - protein, 200 aa, Chlamydia trachomatis
MEKRGVIVHILVCLLTIFGTFSLPAFGAHFLAEEEQFYMDRFVFSGQYPDMETMELHAERKKRVQFDVTGSFPKLESVVYKGSFGLLRSKIKGECPELSSVNLSCTSCRMDLDFRGEWKKNASIYIRNEQEPITIMLPKDIGVVVYTQVDMNSKVVAEGSLIKRGRGFWKKTFRNSLVGESPVTLTFHVETRNGGVIFLR

SEQ ID NO: 134 - DNA, 603 bp, Chlamydia trachomatis
atggagaagagaggcgttattgtgcatatactagtttgtttgttgacaatcttcggaacgttcagtttacccgctttcggcgcgcattttctcgcggaagaagagcagttttatatggatcggtttgttttctctgggcagtatccagatatggaaactatggaaatccatgcagaaagaaaaaaacgtgtacaatttgatgtgacgggaagcttccctaagttggagagcgtggtttataagggatcttttggattgctgcgttcgaaaataaagggagagtgtccagaactgtcttctgtaaatctttcttgtacctcctgcagaatggatttagattttcgaggggagtggaaaaagaatgcgtctatttatattcgtaatgagcaagagccaattacaattatgttgcctaaagacattggtgtagttgtctatacgcaggttgatatgaatagtaaagtagttgcagagggatcactaatcaagagaggaagaggtttttggaagaaaacttttcggaattctttggtaggagaatcccctgtgacgctaacttttcatgtagagactcgtaatggaggagttatttttctccgttag

SEQ ID NO: 135 - protein, 104 aa, Chlamydia trachomatis
MQTSRISSFFRGLVHLYRWAISPFLGAPCRFFPTCSEYALVALKKHPLRKSLFLIAKRLLKCGPWCIGGIDLVPRTSVEEYLSSPTPLAESPDDRTVPHTQETS

SEQ ID NO: 136 - DNA, 315 bp, Chlamydia trachomatis
atgcaaacttcccggatcagctcttttttccgagggcttgttcacctgtaccgttgggcgatttctccttttctcggggctccttgtcgctttttccctacatgctctgagtacgctcttgttgcactaaagaaacatccgctcagaaaaagcctttttctcatcgccaagcgcttactcaaatgcggcccttggtgcataggaggtatcgatctcgtccctagaacttctgttgaagaatatctcagttcccctacccctctagcagaatccccagacgacaggactgtgccacacacccaagaaacttcttag

SEQ ID NO: 137 - protein, 321 aa, Chlamydia trachomatis
MKRLFFICALALSPLAYGAVQKDPMLMKETFRNNYGIIVSKQEWNKRGCDGSITRVFKDGTTTLEVYAQGALHGEVTRTFPHSTTLAVIETYDQGRLLSKKTFFPNALPAKEEVYHEDGSFSLTRWPDNNNSDTITDPCFVEKTYGGRVLEGHYTSFNGKYSSTILNGEGVRSTFSSDSILLTEESFNDGVMVKKTTFYSTREPETVTHYVNGYPHGVRFTYLPGGIPNTIEEWRYGHQDGLTILFKNGCKLAEVPFVRGAKNGIELRYNEQENLAEEISWQHNILHGVRKLHAAGVCKSEWYYKGKPVSQIKFERLSAAR

SEQ ID NO: 138 - DNA, 966 bp, Chlamydia trachomatis
atgaagcgtttattttttatctgcgccctcgccctttctcctctagcatatggagctgttcaaaaggatcctatgttaatgaaggagactttccgtaataactacgggatcattgtctctaagcaagaatggaacaaacgtggatgcgatggctccatcactagagtattcaaagatggaactacaaccttagaagtttatgcgcaaggtgctttacatggggaagtcacacgaacgtttcctcactctactaccctggccgttatagaaacttatgatcagggaaggcttctttctaagaagaccttcttcccaaatgctttgcctgctaaagaagaagtttaccacgaagatgggtctttctccctaacacgttggcctgacaataacaactctgacacaatcacagacccctgctttgtagaaaaaacttatgggggaagagtattggaaggtcattacacctcttttaatggaaaatactcttcaacaatccttaacggcgagggagttcgctctactttttcttcggatagtatcttgttgacagaagagtcgtttaatgatggcgtaatggtcaaaaaaacgacattttactcgactcgagaacccgaaaccgtcactcattatgtcaatgggtaccctcacggagttcggtttacctatcttcctggtgggattccaaatacgattgaagaatggcgatatggacatcaagacggccttacaatcttatttaaaaatggttgtaagattgctgaagtcccatttgtacgcggagcaaaaaatggaatcgaactccgatacaatgaacaagagaatatcgctgaagagatttcttggcagcacaacatcttgcatggagtccgtaaaatccatgcggcgggggtatgcaaatccgaatggtattacaaaggcaaacctgtctcgcaaatcaagtttgaacgactcagcgctgccagataa

SEQ ID NO: 139 - protein, 578 aa, Chlamydia trachomatis
MKEPQTSYQRFFRAYNRRALPSIALKFFIGLMLIGIYAPLFASSKPILVRWHGEWYFPLFRYLLFPGFYTKSIDLFFNVLMLTLPFFILGFRYLSGVWKKLFLGVVTGIHIAVFSFALSGRVQDPCRDELLKQKRAKHLQQELKTTPKTEFLPTIAKRTRTWESERAYMSKYEQLGMLVKAKYRKMQHDHLEKQREAYELCKQSPMPTLRFLEMKNETASLRFLKNKINKLKPSYPEGFEGWGTLLEDYRPYFMARARSEHALNMALYEQHPQEELRAAFEALEEKEAPFREQLAFVRSLLEEREALNNSIAFIMDKRNWIETESEQVQMVLNPLLSSFHWEDDAGGSREMNKYVHWWQLTRINRKDLLASLIFGIRIAIVVGGLGVSIALFIGIIVGLLSGYFGGKVDMLLSRVTELWETMPMLFILMLVVAITQKKSLILDSVLLGCFGWVSISRYVRIETLKQRNLGYVLAATNLCYSHYHIMVHQILPNVIVPVISLLPFSMMAMISCEAGLTFLGLGEESSASWGNLLREGVTAFPSESAILWPPAIMLTLLLMAIAVIGDGIRDALDPKMQD

SEQ ID NO: 140 - DNA, 1737 bp, Chlamydia trachomatis
atgaaggaaccccaaacatcttatcaacgattttttcgtgcttataatagacgggcacttccctctatagctttaaagttctttattggacttatgcttattggtatttacgctcctttatttgcttctagtaaaccgattcttgttcgttggcacggggagtggtatttccccttgttccgttatttgcttttcccaggtttttacactaagtctatcgatttattttttaatgtcttaatgctcacactgccgttttttattttaggctttcgttatctcagtggtgtgtggaaaaagctgtttctaggtgtagtgactggaatacatattgcggtattctcttttgctttgagtgggagagttcaagatccttgtcgggatgagctgttaaagcagaaacgggctaagcatctgcaacaggaattgaaaacaactccaaagacagagtttcttccaacaattgctaaaagaacacgcacttgggaaagtgagcgtgcttatatgagtaaatatgagcagctgggaatgcttgtaaaagccaaatatcgcaagatgcagcacgatcatcttgaaaaacaaagggaggcatacgagttgtgtaagcaatctccgatgccgactctgcgttttctagaaatgaagaacgaaacagcaagcctgcgttttctcaaaaataagatcaacaagttaaaaccttcctatccggaaggttttgaaggatggggaactttgctggaagattaccgtccttatttcatggctagagcacgttcagaacatgctctgaatatggcgatatacgagcaacatccccaagaagagttgcgtgcagcgtttgaggctcttgaggaaaaagaggctccttttagagagcagttggcctttgtacgtagtcttttagaagagcgtgaagctttaaataattcgattgcgtttatcatggataagcgtaattggatagaaaccgagtctgaacaggtacaaatggttttgaatccattattaagcagctttcactgggaagatgatgccggcggatctcgagagatgaacaagtatgtgcattggtggcagcttacacgcattaatagaaaggatttactcgcttctctgatctttgggattcgtattgcgatcgttgttggtggattgggtgtttctatagctttatttataggcatcattgtgggattgttatctggctactttggtggcaaggtagacatgttattatcacgagtgacagaaatttgggagactatgcccatgttgtttattcttatgctcgtggtagctattacacaaaaaaaatctctcatattagattcggtattgctgggatgttttggatgggtcagtattagtcgctatgtgcgtatagaaaccttaaagcaaaggaatttagggtatgttctagctgctaccaacttgtgctacagccattaccatattatggtgcatcagatccttcctaacgtgattgttccggttatttctttattgccgttctcgatgatggctatgattagctgtgaagcagggctcacttttttagggttaggagaggagagttcggcatcttggggaaatcttttgcgagaaggagtcacagcatttccatcagagagcgccattctatggcctcccgctattatgttgacattgttgttaatggctattgctgtgattggagatgggattcgggatgcgttagatcctaagatgcaggattaa

SEQ ID NO: 141 - protein, 696 aa, Chlamydia trachomatis
MIDKIIRTILVLSLFLLYWSSDLLEKDVKSIKRELKALHEDVLELVRISHQQKNWVQSTDFSVSPEISVLKDCGDPAFPNLLCEDPYVEKVVPSLLKEGFVPKGILRTAQVGRPDNLSPFNGFVNIVRFYELCVPNLAVEHVGKYEEFAPSLALKIEEHYVEDGSGDKEFHIYLRPNMFWEPIDPTLFPKNITLADSFLRPHPVTAHDVKFYYDVVMNPYVAEMRAVAMRSYFEDMVSVRVENDLKLIVRWRAHTVRNEQGEEEKKVLYSAFANTLALQPLPCFVYQHFANGEKIVPEDSDPDTYRKDSVWAQNFSSHWAYNYIVSCGAFRFAGMDDEKITLVRNPNYHNPFAALVEKRYIYMKDSTDSLFQDFKAGKVDIAYFPPNHVDNLASFMQTSAYKEQAARGEAILEKNSSDRSYSYIGWNCLSLFFNNRSVRQAMNMLIDRDRIIEQCLDGRGVSVSGPFSLCSPSYNRDVEGWQYSPEEAARKLEEEGWIDADGDGIREKVIDGVVVPFRFRLCYYVKSVTARTIAEYVATVCKEVGIECCLLGLDMADYSQALEEKNFDAILSGWCLGTPPEDPRALWHSEGALEKGSANAVGFCNEEADRIIEQLSYEYDSNKRQALYHRFHEVIHEESPYAFLYSRQYSLVYKEFVKNIFVPTEHQDLIPGAQDETVNLSMLWVDKEEGRCSAIS

SEQ ID NO: 142 - DNA, 2091 bp, Chlamydia trachomatis
atgatagataaaattatacgaacaatactggttctgtccttattcctgttgtattggtcttcagatctacttgaaaaagatgtgaaatcgatcaaaagagaactcaaggctttacatgaagatgttcttgagttagtccggatctcgcatcagcaaaaaaattgggtccagtctacagatttttctgtttctccagagatcagtgtattgaaggattgcggagatcctgcgttccctaatttattatgcgaagacccttatgttgaaaaagtggtcccttcgttgttaaaggaaggttttgttccgaaaggtattttgcgtacagctcaagtaggaaggcctgataacctaagtccgtttaatggctttgttaatatcgttcgattttatgaattgtgcgttcctaatttggctgttgagcatgttggtaaatacgaggagtttgcgcctagtttagccttaaagatagaagagcattatgtagaggatgggtctggggataaagaatttcatatttatttgcgtcctaatatgttttgggagccgatagatcctacgctgttccctaaaaatataactttagcagacagcttcttaagaccacatcctgtcaccgctcatgatgtgaagttctattacgatgtagtcatgaatccctatgttgcagaaatgcgtgcagtggctatgagatcttattttgaggatatggtttcggttcgggtagaaaacgatttgaaattaatcgttcgttggagagctcatactgtacgtaatgaacagggagaggaagagaaaaaagtgctctattctgctttcgcgaatacattggcactccaaccgttaccttgtttcgtgtatcagcatttcgcaaatggagagaagatcgttccagaagattctgatcccgatacgtatcgcaaagattcggtatgggcgcaaaacttttcttcacattgggcgtataattacatagtgagctgtggagcattccgatttgcagggatggatgatgagaaaattactttagttcgtaatcctaattatcataatccgtttgcggctcttgtggagaagcgctatatctatatgaaagatagtacagattctctcttccaagatttcaaagctgggaaggtggatattgcgtatttccctcctaaccatgtcgataatctagcgagcttcatgcaaacctctgcttataaggaacaagctgctagaggagaggcaattttagaaaaaaattcatcagaccggtcctattcttacatcggatggaattgtctttctcttttctttaacaatcgttcggtacgacaagccatgaatatgttgatcgatcgggatcgcattattgagcagtgcttggatggtcgtggagtctctgtgagtgggcctttttctctctgctctccatcatacaacagagatgtagagggatggcaatactctccggaagaggccgcacgtaaattagaggaagagggctggatcgatgctgatggagatggtattcgtgagaaagtaatcgatggagttgtagtgcctttccgtttccggttatgctactatgtgaaaagtgtaacagcacgaacgattgccgaatatgtagctacggtatgtaaagaggtgggtatcgagtgttgcttactcgggttagatatggcggattattcacaagccctcgaggagaaaaatttcgatgctattctttccggatggtgtttaggaacccctccagaagatcctcgtgctctatggcattcggaaggagctttggagaaaggatctgccaatgctgttggattttgtaatgaggaagcagaccgtatcatcgaacagctcagttacgagtatgattctaataagcgccaagccttgtatcaccgttttcacgaggtgattcatgaggaatctccttacgcgtttctctattcaagacagtactcccttgtctataaggagtttgtaaaaaatatttttgtgccaacagaacatcaggatttgattcctggagctcaagatgagacagtgaatttatccatgttgtgggtagataaagaggagggtcgatgctccgctatatcttaa

SEQ ID NO: 143 - protein, 261 aa, Chlamydia trachomatis
MIRGSSLISEVRVKFKYLRPLSFLVLVIVAFCYGCSREKQEILVGRDATWFPQQFGIYTSGINAFVNDLVSEINYKEGLNISIVNQDWVHLFENLDDKKTSGAFTSASPSIEMLARYQFSDPVLLTGPVLVVLENSPYHSLQDLEGKLIGVYKFDSSVLIAQNVPNAVIDSYQHIPVALEALSTQRYDALLVPVLEATALVETAYKGRLRIASEPLNEEGLRLVVLRGGGSDSLLEGFNAGLAKIRRSGRYKAIKMQSRLP

SEQ ID NO: 144 - DNA, 786 bp, Chlamydia trachomatis
atgattcggggatctagtctgatctctgaggttagagtgaaatttaagtatttgcgtccattaagctttttagtcttggttattgtagcgttttgctacggatgttccagagagaaacaagagattctcgtcggaagggatgctacttggttccctcaacaatttggtatttatacatcaggaattaacgcctttgtgaatgatttagtttctgagatcaattacaaggaagggttgaatatctctatagtgaaccaagattgggttcatctttttgagaatttagatgataagaagactagcggagcctttacttcagcctctccttcaatagaaatgttagctcggtaccagttttcagatcccgttttattaaccgggcctgtgcttgttgttttagaaaattctccgtatcattctctccaggatttagaaggaaagttgatcggagtatataaattcgattcatccgttcttattgcacagaatgttcccaatgctgtgattgattcctatcagcatattcctgtagccttagaagctttgtctactcagcgttatgatgcgttattggtgcctgtaatagaggcaactgctttagtagaaacggcttataaaggacgtttgcgaatcgcttcagaacctcttaatgaggaaggtttgcgtttagttgtgttacgaggaggaggatcggattccctattggaaggatttaatgcaggattggcaaaaattcgtcgatcaggaagatacaaagccattaaaatgcaatcccggcttccttag

SEQ ID NO: 145 - protein, 331 aa, Chlamydia trachomatis
MKNFFRFLLKGFLSVCGLFLGVLGAAGFIFVLSASVLGAGDGVLFVNFPNAQGVVQELGKTAPIIAVIDINDAIMASGGAAKRLQSALQPLNEAPYKGRVKGILVKIDCPGGEVFEIDRMCATLSFWKKQWGIPVHVFVSGLCASGGYYVACIADKIGTTSSSLIGSIGVRSGPYFSVKEGLQRHGVETAILTAGDDKAPLNPFSSWTEEEYAERQGIVDAFYEQFVDHVVKYRSKLSKEKLTKVLGARVFIAKQALEEGLVDAINQTQEQALEELAEACGIKDNYRVIGLGSGHFLKRFSSYLSNSPLVTGKLQVTALPDQQQKSLWYMG

SEQ ID NO: 146 - DNA, 996 bp, Chlamydia trachomatis
atgaagaatttttttcgatttttattaaaaggttttttatctgtctgcggtttgtttttaggtgtgataggagctgccggattcatttttgtcctatcggcctctgttcttggggcgggagacggagttttgtttgtcaacttccccaacgctcaaggagttgttcaagagcttgggaaaactgctcccattattgcagtgattgatattaacgatgctattatggctagcggtggcgctgcaaagcgtttacaatccgctttacagcctttaaatgaagctccttacaaaggaagagtaaaagggatcttagtcaaaatagattgtcctggtggtgaggtttttgaaattgatcggatgtgcgcaacactctctttctggaagaaacagtggggaatccctgtccacgtctttgtatctggactctgtgcttccggaggatattatgttgcttgtattgccgataaaattggaaccacttcgagttctctgattggttcaataggagtacgttcgggcccatattttagtgttaaagaaggcttacaacgacatggcgtggaaactgctattcttacagcgggagatgacaaagcgccgttaaatcctttttcttcatggacagaggaagagtacgccgagcgccaggggatagtggatgctttctatgaacagtttgtggatcatgttgttaaatatcgttcgaagctgtctaaggaaaaactaacgaaggttttgggagcccgtgtatttattgcgaagcaagctctggaagaagggttggtggatgcgatcaatcaaactcaagaacaagctttagaagaactggctgaagcctgtggtatcaaagacaattatcgagtcattgggttgggttctggccattttttaaaacgtttttctagctatctaagtaatagcccgcttgtaacagggaaactccaagtgacggctttacctgatcagcaacaaaaatctttgtggtacatgggttga

SEQ ID NO: 147 - protein, 542 aa, Chlamydia trachomatis
MFKLVSYIILSWVLVCLAQPDVSVVASVVSCICGYSLLWAGLFALVEQLSWKKVWCIAFIWTWTVEGAHFSWMLEDLYVGTSIYFVWGILLSYLATLFASFSCLVVWCCRKQYRGALVWLPGVWVAIEAIRYYGLLSGVSFDFIGWPLTATAYGRQFGSFFGWAGQSFLVIAANICCFAVCLLKHSFSKGLWLTLCAFPYLLGGAHYEYLKKHFSDSEVLRVAIVQPGYSPHMHAGRTASAIWRGLVSLCQTIQTPVDVIVFPEVSVPFGLHRQAYTLHENQPVLESLLPNKSWGEFFTNLDWIQAIAERYQCTVIMGMERWENKGGILHLYNAAECVSREGEITSYDKRILVPGGEYIPGGKIGFSLCQTFFPEFALPFQRLPGEFSGVVNITERLKAGISICYEETFGYAIRPYKRQQADILVNLTNDGWYPRSRLPLVHFYHGMLRNQELGIPCIRACRTGVSAAVDSLGRIVGILPWESRTCPVSTGVLQVSVPLYSYHTVYARLGDAPLLLIAVCSVIGAIAYFYRKKKETPPQTFF

SEQ ID NO: 148 - DNA, 1629 bp, Chlamydia trachomatis
gtgtttaaacttgtgtcatacatcatcctttcttgggtgctggtctgtttggctcagccggatgtaagtgttgtagcttctgttgttagttgtatttgcggttacagcttactttgggctgggctttttgctttagtagagcaattatcttggaagaaagtttggtgcatcgcttttatttggacttggactgtcgaaggcgctcatttctcttggatgcttgaagatctttatgtagggacaagcatctattttgtttggggtatactgctttcttatctcgccaccctatttgctagtttttcttgtttggttgtgtggtgttgtcgcaagcaatataggggagctcttgtttggcttccaggggtttgggtggcgatagaagcaatacgctattatgggttgctttcaggagtttcttttgattttattggctggcctcttacagcgacagcctatggccggcaattcggcagcttttttggatgggctggacaaagctttctagttattgctgccaatatatgctgttttgcagtatgtttattaaaacactctttttccaaaggtttgtggttgacgttgtgcgcgttcccttatctgttaggcggagcgcattacgaatacctaaagaagcatttttccgactctgaagtgcttcgagttgccatcgtgcagcctggatatagtcctcatatgcatgcagggaggacggctagtgctatttggagaggtttggtttctttgtgccagactattcaaactcctgtagatgtgatcgttttcccagaagtaagtgttccttttggcttacatagacaagcctatactcttcatgaaaatcagcctgtattagaaagtttgcttcctaacaaatcttggggcgagtttttcacaaatttggattggatccaagcgatagctgaacgttatcaatgcaccgttatcatgggaatggaacgatgggaaaataaagggggaatactgcatttgtataatgctgctgaatgcgtatcgcgagaaggggaaataactagctatgataagcggattcttgttcctggaggtgagtacatccctggagggaaaataggtttttccttgtgtcaaacctttttcccagaatttgctcttccctttcaacgtttgccaggagagttttctggagttgtgaatataacagagcgaataaaagctgggatctctatttgttatgaggagacatttgggtatgcaattcgcccttacaaaaggcaacaagccgatattttagtaaatcttactaatgacggttggtatccgcgttcaaggctgcctctagtacatttttatcatggcatgttacgtaatcaagagttgggtataccttgtattcgcgcctgtcgcacaggagtttctgctgcagtggattctttgggtagaattgtcggcatacttccctgggaatcgagaacttgcccagtttctacaggagtactccaagtttccgtccctctttacagttatcatactgtatatgcaaggctgggtgatgctcctctgttactgattgcagtttgttcggttatcggagcgattgcctatttttataggaaaaagaaagagaccccaccacaaacatttttttga

SEQ ID NO: 149 - protein, 243 aa, Chlamydia trachomatis
MKNILSWMLMFAVALPIVGCDNGGGSQTSATEKSMVEDSALTDNQKLSRTFGHLLSRQLSRTEDFSLDLVEVIKGMQSEIDGQSAPLTDTEYEKQMAEVQKASFEAKCSENLASAEKFLKENKEKAGVIELEPNKLQYRVVKEGTGRVLSGKPTALLHYTGSFIDGKVFDSSEKNKEPILLPLTKVIPGFSQGMQGMKEGEVRVLYIHPDLAYGTAGQLPPNSLLIFEVKLLEANDDNVSVTE

SEQ ID NO: 150 - DNA, 732 bp, Chlamydia trachomatis
atgaagaatatattaagttggatgcttatgtttgcagtcgctctgcctatcgtaggatgtgataacggaggcggttcgcaaacatcggctacggagaaaagcatggtagaagactctgcattgacagacaatcaaaagttatcaagaacttttgggcatttattgtctcgtcagttgagccgaacggaagatttttcgttagatcttgttgaagtgattaaagggatgcaatctgaaatagatggacagagtgctcctttaacagacacagaatatgaaaaacaaatggcagaagtacaaaaagctagtttcgaagcaaaatgctcggaaaatttagcttctgcagaaaaattcttaaaagaaaataaagagaaggctggggttattgagttagagcctaataagttacagtaccgtgttgtgaaagagggtacaggacgggttctttctgggaagcctacagctttgcttcactatacagggagcttcatcgatgggaaggtttttgattcttcagagaagaataaagagcccattttactgcctttgaccaaagtaattcctggattttcccaaggtatgcaaggtatgaaagaaggagaggttcgagttctttacatacatccagatttagcttacggaacagctggacaattacctccaaactctctactcatttttgaagtgaagttaattgaagcaaacgacgataatgtatctgttacagaatag

SEQ ID NO: 151 - protein, 318 aa, Chlamydia trachomatis
MKVILRALCLFLVLPCGCYARVPSFEPFRGAIAPNRYTPKHSPELYFEMGDKYFQAKKFKQALLCFGMITHHFPEHALHPKAQFLVGLCYLEMGHPDLADKALTQYQELADTEYSEQLFAIKYSIAQSFANGKRKNIVPLEGFPKLLKADTDALRIFEEIVTASSDADLKASALYAKGALLFDRKEYSEAIKTLKKVSLQFPSHSLSPESFTLIAKIHCLQALQEPYNEQYLQDARMNAAALRKQHPNHPSNTEVENYIHHMCEAYASCLYSTGRFYEKKRKASSAKIYYSIALENFPDTSYVAKCNKRLERLSKQMS

SEQ ID NO: 152 - DNA, 957 bp, Chlamydia trachomatis
atgaaagtcattttaagagcgctttgcttgtttcttgtgttgccctgcggatgttatgcacgagtgccctcttttgaacctttccgaggcgctatcgccccaaaccggtacactcctaaacattccccagaactctatttcgagatgggagataaatactttcaggctaaaaaatttaagcaagctcttctttgttttggaatgataacacatcatttcccagaacatgctcttcatcctaaagcacagtttcttgtagggctctgctatcttgaaatgggccatcctgacttagcagataaagcgctaactcaatatcaagagctcgccgatacagaatattctgaacaattattcgccattaagtattctatcgcacaaagtttcgctaacggaaaacgtaaaaatatcgttcctttggaagggtttcctaagttgttgaaagcagatacagatgctctgcgtatttttgaagaaattgtgacagcatcttccgacgcagacctcaaagcttctgctctctacgcaaaaggtgctcttttgttcgaccgaaaagaatattcggaagcgatcaaaactctaaaaaaagtttctcttcagtttccttcacactctctttctccagagtcttttacccttattgcaaaaatccattgcttacaagctttgcaagagccctataatgaacagtatcttcaagatgctcggatgaatgcagcagctttacgtaaacaacaccctaatcatcctagcaatacagaagtagagaactatattcatcacatgtgcgaagcttacgcttcttgcttatattcaaccggacgcttttatgagaaaaagcgaaaagcctcttctgcaaaaatttattactcaatagctctagaaaacttccctgatacctcctatgttgctaaatgcaataaacgattagaacggctctctaaacaaatgagttaa

SEQ ID NO: 153 - protein, 194 aa, Chlamydia trachomatis
MLKMFWLNSLVFFSLLLSACGYTVLSPHYVEKKFSLSEGIYVCPIEGDSLGDLVSSLSYELEKRGLHTRSQGTSSGYVLKVSLFNETDENIGFAYTPQKPDEKPVKHFIVSNEGRLALSAKVQLIKNRTQEILVEKCLRKSVTFDFQPDLGTANAHQLALGQFEMHNEAIKSASRILYSQLAETIVQQVYYDLF

SEQ ID NO: 154 - DNA, 585 bp, Chlamydia trachomatis
atgctgaaaatgttttggttgaatagcctcgttttcttctcgttactactatcagcctgcggctatacagtgctctccccccactatgtagaaaagaaattctcgctttccgaaggcatctatgtctgccctatcgaaggagattcattaggagatctcgtatcctctctttcttacgaattagaaaagcgaggactccacacacgatctcaaggaacctcttctggttatgtactcaaagtctctcttttcaatgagactgatgaaaatattggattcgcatacactccccaaaaacctgatgaaaaacctgtaaaacacttcattgtctctaatgaagggcgcttagcgttatcagcaaaagtccaactaatcaaaaaccgcacacaagaaatattagtggagaaatgcctgagaaaatcggttacttttgattttcaacctgacctcggaaccgcgaatgctcatcagctagctctcggacaatttgaaatgcataatgaagcaataaaaagcgcttctcgtatattgtattcgcaattagcagagactattgtacaacaggtatactatgaccttttctga

SEQ ID NO: 155 - protein, 393 aa, Chlamydia trachomatis
MKKLLKSVLVFAALSSASSLQALPVGNPAEPSLMIDGILWEGFGGDPCDPCATWCDAISMRVGYYGDFVFDRVLKTDVNKEFQMGAKPTTDTGNSAAPSTLTARENPAYGRHMQDAEMFTNAACMALNIWDRFDVFCTLGATSGYLKGNSASFNLVGLFGDNENQKTVKAESVPNMSFDQSVVELYTDTTFAWSVGARAALWECGCATLGASFQYAQSKPKVEELNVLCNAAEFTINKPKGYVGKEFPLDLTAGTDAATGTKDASIDYHEWQASLALSYRLNMFTPYIGVKWSRASFDADTIRIAQPKSATAIFDTTTLNPTIAGAGDVKTGAEGQLGDTMQIVSLQLNKMKSRKSCGIAVGTTIVDADKYAVTVETRLIDERAAHVNAQFRF

SEQ ID NO: 156 - DNA, 1182 bp, Chlamydia trachomatis
atgaaaaaactcttgaaatcggtattagtatttgccgctttgagttctgcttcctccttgcaagctctgcctgtggggaatcctgctgaaccaagccttatgatcgacggaattctgtgggaaggtttcggcggagatccttgcgatccttgcgccacttggtgtgacgctatcagcatgcgtgttggttactacggagactttgttttcgaccgtgttttgaaaactgatgtgaataaagaatttcagatgggtgccaagcctacaactgatacaggcaatagtgcagctccatccactcttacagcaagagagaatcctgcttacggccgacatatgcaggatgctgagatgtttacaaatgccgcttgcatggcattgaatatttgggatcgttttgatgtattctgtacattaggagccaccagtggatatcttaaaggaaactctgcttctttcaatttagttggattgtttggagataatgaaaatcaaaaaacggtcaaagcggagtctgtaccaaatatgagctttgatcaatctgttgttgagttgtatacagatactacttttgcgtggagcgtcggcgctcgcgcagctttgtgggaatgtggatgtgcaactttaggagcttcattccaatatgctcaatctaaacctaaagtagaagaattaaacgttctctgcaatgcagcagagtttactattaataaacctaaagggtatgtaggtaaggagtttcctcttgatcttacagcaggaacagatgctgcgacaggaactaaggatgcctctattgattaccatgaatggcaagcaagtttagctctctcttacagactgaatatgttcactccctacattggagttaaatggtctcgagcaagctttgatgccgatacgattcgtatagcccagccaaaatcagctacagctatttttgatactaccacgcttaacccaactattgctggagctggcgatgtgaaaactggcgcagagggtcagctcggagacacaatgcaaatcgtttccttgcaattgaacaagatgaaatctagaaaatcttgcggtattgcagtaggaacaactattgtggatgcagacaaatacgcagttacagttgagactcgcttgatcgatgagagagcagctcacgtaaatgcacaattccgcttctaa

SEQ ID NO: 157 - protein, 921 aa, Chlamydia trachomatis
MNIVTSKIGSKILRIIQNNKKLGLLSALVVLDAALLSVNSRSSEGLIGQSASLPNYHETEQQLAACPKNIAKNLAKKSSPGSKPTVGASFPSQPVSVKAAPAKPQTPVAQTRHFKKSHQIFSPNFTQSPQQVNKPEERRRPLESRYLQGAVKQAAAAKEKKALEQEVSKQEEEASKLWEEKQSYARRAVNAINFSVRKQIEEQQKTISNPGNDQTLPRKKDPQTSGEPVIQTVQDCSQDQEEEKKVLERLNKRSLTCQDLKEVEYTVNFEDISILELLQFVSKISGTNFVFDSNDLQFNVTIVSHDPTSVDDLATILLQVLKMHDLKVVEQGNNVLIYRNPKLSKLSTVVTDGSAKDTCEAVVVTRVFRLYSVSPSAAVGIIQPLLSHDAIISASESTRHIIVSDIAGNIEKVRELLQALDSPGTAIDMSEYDVQFANPAALVSYCQDVLGAMAEEEAFQIFIQPGTNKIFVISSPRLTAKTIQLLESLDIPEMAHTLDDVTSPAAALGSSGAANPKSLRFFMYKLKYQNGAAIAQAIQDIGYNLYVTTAMDEDFINTLNSIQWLPVNNSIVVIGNQANVDKVVSLLNGLDLPPKQVYIEVLILETSLEKSWDFGVQWAALGDEQGKVAYASGLLSNTGLTDPLRNQSLPVAPNPGNISLPTPGQLAGISDMMYGSSAFGLGIIGNVLSHNGKSYLTLGGLLSALDQDGDTTVVLNPRLMAQDTQQASFFVGQTIPFQTTSTVIQETGSVTQNIEYEDIGVNLVVTSTIAPNNVVTLQIEQTISELHSAQGVLTPVTDKTFAATRLQVPDGCFLVMSGHIRDKLTKIVSGVPLLSSLPLIKGLFSRSIDQRQKRNIMIFIKPKVISSFEEGTALSNTEGYRYNWESERGSLEVAPRHAPECQHIPKVQAESDFKMLEIEAE

SEQ ID NO: 158 - DNA, 2766 bp, Chlamydia trachomatis
gtgaacatagtgacgtcgaaaataggaagcaagattttaagaatcattcaaaataacaagaaattaggcctcttgtctgcgttagttgttctagatgcggcgttgttaagtgtgaattcacgatctagcgaaggcttaataggccaatccgcttctttgccgaattatcatgagacagaacagcagatcgctgcttgtcctaaaaatattgctaagaatttagcaaagaaaagctctccggggtctaaacctacagtaggagcttcatttccttcacagccagtttccgtgaaggcagctcctgcaaagccacaaactcctgttgcacaaacacggcattttaaaaagagccatcagattttctctcctaattttacacagtctccccaacaggttaataaacctgaggaaagaagacgtcctttggagtctcggtatttacaaggtgcggttaagcaggcagctgctgcaaaggaaaagaaggctcttgaacaggaagtatccaaacaagaagaagaggcatctaaactctgggaagagaagcaaagttatgctcgtcgtgcagttaatgccatcaatttcagtgtaagaaagcagatagaagagcaacagaaaaccatttccaatccaggaaatgaccagactcttcctaggaagaaagatccgcagacatctggagaacctgttatccaaacggtacaagactgttctcaggatcaagaagaagagaaaaaagttttagagcgattaaataaacgttctctgacgtgtcaggatctgaaagaagttgaatataccgtcaattttgaggacatttctatcttagaattgctccagtttgtcagtaagatctcaggaacgaatttcgttttcgatagcaatgacttgcaattcaatgtcactatcgtttctcatgatcctacttccgtggatgatttagcaacgattctattgcaagtcttgaaaatgcatgacttgaaagtcgttgaacaaggaaataatgtattgatctaccgcaatcctaagctttccaagctttctacggtggttacagatggatcagcaaaagatacttgtgaggctgtagtagttacacgagtatttcgcttgtacagcgtcagtccttccgctgcggtaggcattattcaaccgctgctctctcatgatgcaattattagtgcttccgagtctacgagacacattatcgtatcagatatagcaggaaatattgagaaagtccgggagttattgcaagcattggatagcccaggcaccgctattgacatgtcggaatatgatgtgcagtttgcaaatcccgctgctttggtcagctattgtcaggatgttctcggtgccatggctgaggaagaggcttttcaaatttttattcagcctgggaccaataaaatttttgttatttcctcgccacgattaacagcaaagacaattcaattattggagtccttggacattccagaaatggcacatacgctagacgatgtcacaagtcctgctgctgctttgggaagctctggagctgctaatcctaagagtttgcgcttcttcatgtacaaattaaaatatcaaaatggggcagctatcgctcaggcgattcaagatattggatacaatctatacgtgacaacagcaatggatgaggatttcatcaacacattgaatagtattcaatggttgcctgtaaacaactccatcgttgtcattggaaatcaagctaacgtcgataaggtcgttagcttgctaaatgggttggacctccctccaaaacaagtgtacattgaagtattgattctagagacaagcttagagaagtcttgggacttcggagtacaatgggcggctcttggagatgaacaagggaaggtggcatatgcttccggattgttgagtaatacaggattaacggatccccttcgtaatcaatctctacctgtagcaccaaacccagggaatatctcattgccaacacccggtcagttagcagggatcagtgatatgatgtacggatcctctgcatttggactaggaattattggaaacgttctcagccataatgggaaatcgtatttaacattaggggggttattgagcgccttagatcaagatggggataccacagtggtacttaaccctagaattatggcgcaagatacacaacaggcatcgttctttgtaggacaaacgattccgttccagactacgagtacagtgattcaggaaaccggatctgttacacaaaatattgaatacgaagatatcggagtcaatcttgttgtaacttcgacaatagctcctaataacgtagtaactttacaaatcgagcaaacgatttctgagttgcattcggcacaaggagtgctgactcctgtaacagataaaacatttgcagctacgagactacaagtgccggatggatgtttcctcgtcatgagtgggcatattcgtgataaactgacaaaaattgtatccggagtgccgttactcagttctcttcctctgatcaaaggactctttagtcggtctatcgatcagcgtcagaaacggaatattatgattttcattaagccgaaagtcatcagtagcttcgaggaaggaacagcgttatcaaacacagaaggatatcgttataactgggaaagcgaaagaggatctttagaggtagcccctcgtcatgcccctgaatgccaacatattcctaaggtccaagcagaaagtgattttaaaatgctggaaatagaagcggaataa

SEQ ID NO: 159 - protein, 829 aa, Chlamydia trachomatis
MGIRLVIDKGPLSGTVLILENGTSWSLGSDGKASDILLQDEKLAPSQIRITLKDGEYYLENLDALRPVSVDGTVITAPVLLKDGVSFVMGSCQVSFFKGEEVEGDIELSFQTEGGNEGEPAAQGSSSVSSEAPKKETGNPSLPSEAKASGEVSSSAIAKEQELAASFLASVEKEPGTPKEVSEPKVSSQEGQTPSVTGEKKDLELPLASQEQPKQTTPSGSGEPTQSQNASMEENRTSPDQNQQPQLSSASESGSQSPENQEQQPSQTPPPSPETPEPSGEPNSATEENSPSPMEKASVTEEGSSGTSEEEKEGEEDTAESAANEEPKAEASQEEEKKEEDKGEVLAPFNVQDLFRFDQGIFPAEIEDLAQKQVAVDLTQPSRFLLKVLAGANIGAEFHLDSGKTYIVGSDPQVADIVLSDMSISRQHAKIIIGNDNSVLIEDLGSKNGVIVEGRKIEHQSTLSANQVVALGTTLFLLVDYAAPSDTVMATISSEDYGLFGRPQSPEELAARAAEEEEEKRKRATLPTGAFILTLFIGGLALLFGIGTASLFHTKEVVSIDQIDLIHDIEHVIQQFPTVRFTFNKNNGQLFLIGHVRNSIDKSELLYKVDALSFVKSVDDNVIDDEAVWQEMNILLSKNPEFKGISMQSPEPGIFVISGYLKTEEQAACLADYLNLHFNYLSLLDNKVIIESQVMKALAGHLVQSGFANVHVSFTNGEAVLTGYINNKDADKFRTVVQELQDIAGLRAVKNFVVLLPAEEGVIDLNMRYPGRYRVTGFSKCGDISINVVVNGRILTRGDILDGMTVTSIQSHCIFLEREGLKYKIEYNK

SEQ ID NO: 160 - DNA, 2490 bp, Chlamydia trachomatis
atgggtatacgcttagttattgataaagggcccttgtctggaactgttcttattttagaaaatgggacgagttggtctcttggcagtgatggaaaagctagtgatattctcctgcaagatgaaaagcttgctccctctcagattcgcatcactttaaaagatggcgagtattatttagaaaatttagatgctttgaggccggtttctgttgatggaacagttatcactgcccctgttttgttaaaagatggggtttcctttgtaatgggaagctgccaagtctcgttttttaaaggggaagaggtagaaggagatatagagttatcgttccagacagaaggtggtaatgagggagagcctgcagcgcaaggctcttcaagcgtttcgtccgaagctcctaaaaaggagacagggaatccaagtcttccttcggaggcaaaggcttctggagaagtatctagttcagcaatagcgaaagaacaagagttagcggcgtcctttttagcttctgttgagaaggagcctggaacaccaaaagaagtctctgagccaaaggtctcttcacaagaaggacagactccttctgttacaggagaaaaaaaggatcttgagcttcctttggcaagtcaagaacaacctaaacaaactactccatcaggcagtggtgaaccaacccaatctcaaaacgcgagtatggaagaaaacagaacgtcgcccgatcaaaatcagcagccacagctttcttctgcttcagaatcgggttctcaaagtcccgaaaatcaggagcaacaaccttctcaaacgcctcccccatccccggaaactccagagccgtcaggagaacctaatagcgctacggaagaaaactcgccatctccaatggagaaagcttccgtaacagaagaaggcagctcagggacgagtgaagaagaaaaagagggtgaagaagatactgctgaaagcgcagcaaatgaagagccaaaggcagaggcttctcaagaagaagagaagaaagaggaagataaaggagaggttcttgctccctttaatgttcaggatcttttccgttttgatcaaggaatcttccctgctgagatagaagatcttgcacagaaacaagttgcggttgatttgacgcaaccatcacgatttttgttgaaggttcttgctggtgcgaatatcggtgctgaattccatttggatagtgggaaaacctatatcgtaggaagtgatccgcaggttgcagacattgtcttaagtgatatgagtatttcgcgccaacatgcgaagatcattatcggaaatgataattcagttttgattgaagatctgggtagtaagaatggcgtgattgttgaagggcgcaagattgaacatcaatctacgctctctgcgaatcaagttgttgctctaggaacaacgttattcttacttgtcgactatgctgctccttccgatacggtaatggcgacgatttcttctgaagattatgggttatttggtcgtccgcaatctcctgaagagattgctgccagagctgcggaagaggaagaagagaagagaaaacgtgctacgttgccaacaggtgcttttatattaaccttgttcattggagggttagctctgctctttggaataggaacagcttctttgttccatacgaaggaagtagtttctatagatcaaatcgatttgattcatgatattgaacatgtaattcagcagtttccaactgtacggtttacgttcaataagaacaacggacagttgttcttaattgggcatgtaagaaatagcattgataagagcgagttactttacaaagtggatgctctctcgtttgtcaagtcggtagatgataacgtgatcgatgacgaggcagtatggcaagagatgaatattctcttgtctaagaatccagaatttaaaggtatcagcatgcaatctccagagccggggatttttgtaatcagcgggtatctaaagacagaagaacaagcagcttgtttggctgattatctaaatctacattttaattacctttcactattggataataaggtgattatcgaatcacaagtcatgaaagctcttgctggacatcttgtgcaatcaggttttgcgaacgttcatgtgtccttcaccaatggtgaagctgttttgacaggatatatcaataataaagatgcagataaattccgaacggttgtgcaagaactgcaagatattgcagggattcgtgcggtgaagaattttgtcgttttgctgcctgcagaagaaggtgttattgatctaaatatgcggtatccaggccgttatcgggtaaccggtttttcaaagtgcggggatattagtattaatgttgtagttaatgggcgtattttaactcgaggcgatattttagatggaatgacggtaacaagcattcaatcgcattgtatctttttagaacgggaagggttgaaatataaaattgagtacaataaatag

SEQ ID NO: 161 - protein, 647 aa, Chlamydia trachomatis
MESGPESVSSNQSSMNPIINGQIASNSETKESTKESEASPSASSSVSSWSFLSSAKHALISLRDAILNKNSSPTDSLSQLEASTSTSTVTRVAARDYNEAKSNFDTAKSGLENATTLAEYETKMADLMAALQDMERLAKQKAEVTRLKEALQEKQEVIDKLNQLVKLEKQNQTLKETLTTTDSADQIPAINSQLEINKNSADQIIKDLEGQNISYEAVLTNAGEVLKASSEAGIKLGQALQSIVDAGDQSQAAVLQAQQNNSPDNLAATKKLIDAAETKVNELKQEHTGLTDSPLVKKAEEQISQAQKDIQEIKPSGSDIPIVGPSGSAASAGSAVGALKSSNNSGRISLLLDDVDNEMAAIAMQGFRSMIEQFNVNNPATAKELQAMEAQLTAMSDQLVGADGELPAEIQAIKDALAQALKQPSTDGLATAMGQVAFAAAKVGGGSAGTAGTVQMNVKQLYKTAFSSTSSSSYAAALSDGYSAYKTLNSLYSESRSGVQSAISQTANPALSRSVSRSGIESQGRSADASQRAAETIVRDSQTLGDVYSRLQVLDSLMSTIVSNPQVNQEEIMQKLTASISKAPQFGYPAVQNSADSLQKFAAQLEREFVDGERSLAESRENAFRKQPAFIQQVLVNIASLFSGYLS

SEQ ID NO: 162 - DNA, 1944 bp, Chlamydia trachomatis
atggaatcaggaccagaatcagtttcttctaatcagagctcgatgaatccaattattaatgggcaaatcgcttctaattcggagaccaaagagtccacgaaggagtcagaagcgagtccttcagcatcgtcctctgtaagcagctggagttttttatcctcagcaaagcatgcattaatctctcttcgtgatgccatcttgaataaaaattctagtccaacagactctctctctcaattagaggcctctacttctacctctacggttacacgtgtagctgcgcgagattataatgaggctaaatcgaattttgatacggcgaaaagtggattagagaacgctacgacacttgctgaatacgagacgaaaatggctgatttaatggcagctctccaagatatggagcgtttggctaaacagaaggctgaagttacaagaattaaagaagctcttcaagagaaacaagaggttattgataagctcaatcagttagttaaacttgaaaaacagaatcagactttaaaggaaactttaacaaccacagactctgcagatcagattccagcgattaatagtcagttagagatcaacaaaaattctgcagatcaaattatcaaagatctggaaggacaaaacataagttatgaagctgttctcactaacgcaggagaggttatcaaagcttcttctgaagcgggaattaagttaggacaagctttgcagtctattgtggatgctggggatcaaagccaggctgcagttcttcaagcacagcaaaataatagcccagataatatcgcagccacgaagaaattaattgatgctgctgaaacgaaggtaaacgagttaaaacaagagcatacagggctaacggactcgcctttagtgaaaaaagctgaggagcagattagtcaagcacaaaaagatattcaagagatcaaacctagtggttcggatattcctatcgttggtccgagtgggtcagctgcttccgcaggaagtgcggtaggagcgttgaaatcctctaacaattcaggaagaatttccttgttgcttgatgatgtagacaatgaaatggcagcgattgcaatgcaaggttttcgatctatgatcgaacaatttaatgtaaacaatcctgcaacagctaaagagctacaagctatggaggctcagctgactgcgatgtcagatcaactggttggtgcggatggcgagctcccagccgaaatacaagcaatcaaagatgctcttgcgcaagctttgaaacaaccatcaacagatggtttagctacagctatgggacaagtggcttttgcagctgccaaggttggaggaggctccgcaggaacagctggcactgtccagatgaatgtaaaacagctttacaagacagcgttttcttcgacttcttccagctcttatgcagcagcactttccgatggatattctgcttacaaaacactgaactctttatattccgaaagcagaagcggcgtgcagtcagctattagtcaaactgcaaatcccgcgctttccagaagcgtttctcgttctggcatagaaagtcaaggacgcagtgcagatgctagccaaagagcagcagaaactattgtcagagatagccaaacgttaggtgatgtatatagccgcttacaggttctggattctttgatgtctacgattgtgagcaatccgcaagtaaatcaagaagagattatgcagaagctcacggcatctattagcaaagctccacaatttgggtatcctgctgttcagaattctgcggatagcttgcagaagtttgctgcgcaattggaaagagagtttgttgatggggaacgtagtctcgcagaatctcgagagaatgcgtttagaaaacagcccgctttcattcaacaggtgttggtaaacattgcttctctattctctggttatctttcttaa

SEQ ID NO: 163 - protein, 432 aa, Chlamydia trachomatis
MKKYFYKGFVGALLLACGSTNLAFAQASSMDSQLWSVEDLDSYLSSKGFVETRKRDGVLRLAGDVRARWIYAKEDLETTQTPAKPMLPTNRYRSEFNLYVDYTAANSWMTSKMNWVTIAGGESSAAGLDINRAFLGYRFYKNPETQAEVFAEIGRSGLGDIFDSDVQFNSNFDGIHLYAARRISEKLPFTMIVHGGPFVVNMAEKEYAWVVEAILNKLPGNFVVKTSVVDWNTLTAKTNDPADASAAQPAKPNTKYDYLVWQWLVGKSTAMPWFNGQTKNLYTYGAYLFNPLAEIPENWKQSTTPTTKITNGKENHAWFIGCSLGGVRRAGDWSATVRYEYVEALAIPEIDVAGIGRGNQMKYWFAQAIKQGLDPKESNGFTNYKGVSYQFVMGLTDSVSFRAYAAYSKPANDNLGSDFTYRKYDLGLISSF

SEQ ID NO: 164 - DNA, 1299 bp, Chlamydia trachomatis
atgaaaaaatacttttataaagggtttgtaggcgcgcttttattagcttgtgggtctacaaacttggcttttgcgcaggctagttcgatggatagccagctatggtctgttgaagatttagattcttatttgagttccaaaggttttgtcgagactcgtaagcgcgatggagttctacgtttagctggagatgtccgcgctcgatggatttatgcaaaagaggatcttgagacaactcagactcctgctaaacctatgttacctaccaatcggtatcgtagtgaattcaatttgtatgtggattacaccgctgctaatagttggatgacttcgaaaatgaattgggtaacgattgctggcggagaatcttctgcagcagggttagatattaatcgtgccttcttaggataccgattctacaaaaacccagaaacgcaagcagaagtatttgcagagattggtcgctctggattgggagatatttttgattccgacgttcagtttaatagtaatttcgacggaattcatttatacgctgcgcgacgtattagtgagaaacttcctttcaccatgattgttcatggtggtccttttgtcgtgaatatggcagagaaagagtatgcttgggtcgtggaagctattttgaataaactcccaggaaatttcgttgtgaaaacgagtgttgttgactggaatacgttaacagcaaaaacgaatgatccagcagacgcaagcgctgcacaaccagctaaacctaataccaagtacgattatttagtatggcaatggttggttgggaagagcacagctatgccatggtttaatggacaaacaaaaaatctttacacttacggagcctatctctttaatccattagcggaaataccagagaactggaaacaatcaacaactcctacaaccaaaattacaaatggtaaggaaaaccatgcttggttcatcggctgctctctaggcggtgttcgacgagctggagactggtctgcaacagttcgttatgagtatgttgaagctttagcgattccagaaattgatgtcgcgggtattggtcgcggaaaccaaatgaaatattggtttgctcaagctatcaaacaaggattggatcctaaagaatctaacggctttactaactataaaggagtttcctatcagtttgttatgggtctgacagattcggtttctttccgagcttatgctgcttattctaagcctgctaacgataaccttggtagcgacttcacctatcgtaagtatgacctaggtttaatttcttcattctaa

SEQ ID NO: 165 - protein, 536 aa, Chlamydia trachomatis
MRKDDEGSLVRSLFNLLSGTFFSRLTGMLREIVMATYFGADPLVASFWLAFRTIFFLRKLLGGPILGLAFIPHFEFLRAQNISRATFFFRSFSRFFCYSAILFTLIIELGLCVWCSCVTGSLFDTLLLTIILLPSGIFLMMYTVNSTLLHCEKKFFSVGLAPSVVNVSWIGTVFLARNYDPRNRIFGLAVVLVIGFILEWAVTLPGVMKFLGQSKEVPQERDSLRALIAPLSLGLLSMGIFQLNLLCDMWLARYLNEVGPLYLMYSVRIQQLPVHLFGLGVFTVLLPAISRCVQDQEHQQGYDLLRFSLKLTVAVMVVMTMGLLLFALPGVRVLYEHGVFPKTAVHALVEVLRGYSGSIIPMALAPLVSALFYARRNYKVPMLVGLLAAVVNMVLNVIGCLVCKQVAVLAYATSLVSWGQLAMLWYCAGKSLPTYKGLMWRTFKESGKTVITTILAAVITIGVNIVTHTTYVVFIEPLTVPTKPLVSFLDQCGVFFAESALFLSVLFGLAKLLKTEDLMNLISFQYWKGHQSILRN

SEQ ID NO: 166 - DNA, 1611 bp, Chlamydia trachomatis
atgaggaaagatgatgaaggatcgctagtgcgctcattgtttaatttgctgtccggaacgttttttagtcgtcttactgggatgttacgagaaattgttatggctacatatttcggagccgatcccttagtagcatctttttggctggcttttcggacgatcttttttttaagaaagcttttaggtgggcctattcttggactcgcttttattccgcatttcgagtttttacgtgcgcaaaatatttctcgagcaacgtttttctttagaagcttttcgagattcttttgttacagcgctatattatttactttaattatagaattaggactctgtgtttggtgttcttgcgttacaggaagcctatttgataccctacttttaacaatcatactgctaccttccgggatctttctgatgatgtatacagtgaattccacgctgttgcattgtgagaagaagtttttcagcgtaggacttgctccttctgttgttaatgtgtcgtggattggaacggtctttttagcacggaattatgatccgaggaatcgtatttttggattagctgtagtccttgttataggcttcattttagaatgggctgttacgcttcctggagtcatgaagtttttgggacaaagtaaagaggttcctcaggagcgggatagtatccgtgctctgattgccccactgtctctaggattgttatccatgggaatctttcagttgaacttactatgtgatatgtggctcgcgcgatatatcaatgaggtaggacctctgtatctgatgtattccgtgcgaatacaacagttacctgtccatttatttggtcttggagtcttcacagtgttgctacctgcgatttctcgttgcgttcaagatcaagaacatcaacaaggatatgatctcttgcggttttcgttgaagctcactgttgctgttatggtggttatgacgatggggctattgctttttgctttgcctggggtgcgagtgttatatgagcacggagtgtttcctaaaacagctgtgcacgctattgtagaagttctaaggggatatagtggaagtattattcctatggctttagctcctctcgtatcggctctattctatgcaagaaggaattacaaagttccgatgctggtagggatcattgctgccgtagtgaatatggttcttaatgtgatcggatgtttagtttgcaaacaggttgctgttttagcctacgctacttctttagtgtcgtggggtcagttagcgatgctatggtattgtgctggtaagagtcttcctacttacaaaggattgatgtggagaacgtttaaagagagtgggaaaactgtcattacaaccattctagcagcggttattacgattggtgtgaacatagtaacgcataccacgtacgtagtatttatcgagccattaacagtcccaacaaaacctttagtatcttttttagatcagtgtggagtcttttttgcagaatcggcacttttcttatcagtattgtttggattagctaaattactaaagacagaagatcttatgaatcttatttctttccaatactggaaagggcatcagtctatcctaagaaactag

SEQ ID NO: 167 - protein, 424 aa, Chlamydia trachomatis
MCVSRSLRWCLCFLLLCGWVDAGVYDKLRLTGINIIDRNGLSETICSKEKLQKYTKIDFLSPQPYQKVMRTYKNAAGESVACLTTYYPNGQIRQYLECLNNRAFGRYREWHSNGKIHIQAEVIGGIADLHPSAEAGWLFDGTTYAHDSEGRLEAVIHYEKGLLEGISLYYHANGNVWKECPYHKGVAHGDFLVFTEEGSLLKKQTFCKGQLSGCVLRYEPGSQSLLSEEEYKQGKLRSGKYYDPLTKEEIACVVNGKGKQVIYGKYAIIETRQIVHGVPHGEVLLFDEHGKSLLQAYSLINGQKEGEEVFFYPGGEGRKMLLTWSQGILQGAVKTWYPNGALESSKELVQNKKTGILMLYYPEGQVMATEEYVDDLLIKGEYFRPNDRYPYAKVEKGCGTAVFFSATGGLLKKVLYEDGKPVIH

SEQ ID NO: 168 - DNA, 1275 bp, Chlamydia trachomatis
atgtgtgtaagtagaagcttaagatggtgtttatgttttcttttgctgtgcggatgggtggacgctggggtttatgataagctccgactgacaggcattaacattatcgataggaatggtctttctgagacgatctgttctaaagaaaaattacaaaagtatacgaaaatcgattttctctctcctcagccttaccaaaaagtcatgcgtacatacaaaaacgcagcaggcgagtcggttgcttgtttaacgacgtactatccgaatggccaaatccgacaatatctcgagtgtttaaataatcgtgcttttggacgttatcgtgagtggcatagtaatggcaaaattcatatccaggcagaagttattggagggatagcagatttgcatccttccgcagaagccggatggttgttcgatggaacaacgtatgcacatgatagcgaagggcggttagaagctgttattcattatgaaaaaggcttgctggaagggatttcgctgtattaccacgcgaatgggaatgtatggaaggaatgtccttaccataaaggtgttgctcatggagactttttggtcttcaccgaagaaggaagtttgttaaagaaacaaactttttgtaaagggcagttgtctggatgtgtattacgctacgagccaggttcacagtcattgttgtcagaagaagaatataaacaagggaaactgcgcagtggtaaatattacgatcctcttactaaggaagaaatcgcgtgcgtagtgaatggcaaaggtaaacaagtaatttatgggaaatatgcgattatagagacccgacagattgtacatggcgttcctcacggggaagtcttgttatttgatgaacatggtaaatctctgttgcaagcatattctctaatcaatgggcagaaagagggagaagaagtatttttctatccaggcggagaaggtagaaaaatgttattaacatggtcccaaggtattctacaaggagctgtgaaaacttggtacccaaatggcgctttggaaagtagcaaagaacttgttcaaaataaaaagactgggattctcatgctatactatcccgaaggacaagtgatggctaccgaggaatatgtagacgatcttctcataaaaggagaatatttccggccgaacgaccgatatccatatgctaaagtggaaaaaggttgtgggacagcggtctttttcagtgctacaggaggactgttaaagaaagtcctctatgaagatgggaagcctgttattcattag

SEQ ID NO: 169 - protein, 192 aa, Chlamydia trachomatis
MRRLGVWVLLLLASGAASLPAIGAWCWRQRTAEAWENLLIDMRDFQSKRERSSQVAIKNARLKAAHKQASFPNWIAQGENLVFLNKERDALAKLPATAWVVRSRAVKDRKAFLEDNRLSWQEQTLGEKSTLFSFQKELQIDDEDIPVLLGLFDPKYTQIPIVFLSYWEMTKQVSSLGNEVWVVHAEAWGRCV

SEQ ID NO: 170 - DNA, 579 bp, Chlamydia trachomatis
atgcgacgcttaggagtatgggtgctgttactattagcgagtggggctgcttctcttcctgcaataggagcatggtgttggcgtcagcgtacagcagaggcttgggaaaatttactcatcgatatgagagattttcagtctaaacgagagcgatcttctcaggtagcaatcaagaatgcgcggctgaaagcagcgcataaacaagcgagtttccccaattggattgcccaaggagagaatctcgttttcttgaataaggagcgagatgctctagctaaacttcctgcaacagcctgggtggtgagaagtcgtgcagtcaaggatcggaaggctttcttagaagataaccgcttgtcatggcaggagcagactttaggagagaaaagcacgctgttttctttccaaaaagagctccaaatagatgacgaggacattcctgtattattaggattgtttgatcctaagtatacccaaatacccattgtttttctttcttactgggaaatgacgaagcaggtgtcatcattaggaaatgaggtgtgggtcgttcacgcggaggcttggggacgatgtgtgtaa

SEQ ID NO: 171 - protein, 409 aa, Chlamydia trachomatis
MKTICKLVILALLFPNVSYALVQVGLERVFQEEKYLEKIRGKRVALISHSAAINRQGEHSLCVFNKHKGVCKLSALCTLEHGYFGASLAETPGYDPILEDIPVISLFASKEIPAEVLEACDVFVYDVQDIGVRSYSFISALLQVVKASASSKKELIVLDRPNPMGGNLVDGPLPDKEAFPAIPYCYGMTPGELALLYRARYAPNASVTVVPMQGWKRSMIFADTGLIWVPTSPQIPDAQSAYFYATTGLIGALSITNIGIGYTLPFKVLGAPWMDGCKVAQELNKARLPGVHFLPFMYEPFFGKFKMEMCSGVLVVLQDPKQFLPMETQSVILGVLKTLYPKEVEQAFLLLDRLVPRRKAIQNLLGHSEFLNVCLHKKYITWPLRTLCAEGRKQFIEQRQPFLLPEYAR

SEQ ID NO: 172 - DNA, 1230 bp, Chlamydia trachomatis
atgaaaacaatctgtaagctagtgatccttgcgctactatttcctaatgtgagctatgctcttgtacaggtaggcttggaacgcgtgtttcaagaagaaaaatatcttgagaaaatacgtggcaagcgggttgcattgatttctcatagtgcagccattaatcgacaaggggaacattcgctttgtgtttttaacaagcataaaggggtttgtaagctcagtgctttatgcacactagaacatgggtattttggggcatccattgctgagacaccaggatatgatcctatcttagaagatatcccagtcatttctctatttgcttctaaagagattcctgctgaagtcattgaggcctgcgatgtttttgtgtacgatgtacaagatattggtgtgcggtcctattcattcatttctgcattgttgcaagtcgtaaaagcatctgcgagcagcaagaaggaattaattgttctggatcgtcccaatcctatgggagggaatcttgtcgatggccctctccctgataaagaggctttccctgcgattccctattgctatgggatgacaccaggtgaactagctttattgtatcgagctcgatatgcacccaatgcctcggtgacagttgtccctatgcaagggtggaagcgctccatgatttttgctgatacaggattgatttgggttcctacaagtcctcagattccagatgcgcagtctgcatatttttacgctacaacaggtattataggagctttatctatcacaaacatagggataggctatacgcttccctttaaagttttaggggctccctggatggatgggtgtaaggtcgctcaggagttaaataaagcgcggctaccaggcgtccattttcttccttttatgtatgagccgttttttgggaaatttaaaatggaaatgtgttctggagttttggtcgtacttcaagatcctaaacaatttcttcctatggaaacacaaagtgtgattttgggagttttgaaaactttataccctaaagaggtagagcaagccttcttattattagatcggttagtgcctcgacgtaaggcaattcaaaatttattagggcattcggaatttttgaatgtctgtttacacaaaaagtatatcacatggccgttacgaactctgtgtgcggaaggtagaaaacaatttatagaacagcgacaacccttccttctcccagaatatgctcgatag

SEQ ID NO: 173 - protein, 188 aa, Chlamydia trachomatis
MRKTIFKAFNLLFSLLFLSSCSYPCRDWECHGCDSARPRKSSFGFVPFYSDEEIQQAFVEDFDSKEEQLYKTSAQSTSFRNITFATDSYSIKGEDNLTILASLVRHLHKSPKATLYIEGHTDERGAAAYNLALGARRANAVKQYLIKQGLAADRLFTISYGKEHPVHPGHNELAWQQNRRTEFKLHAR

SEQ ID NO: 174 - DNA, 567 bp, Chlamydia trachomatis
atgagaaagactatttttaaagcgtttaatttattattctcccttctttttctttcttcatgctcttatccttgcagagattgggaatgccatggttgcgactccgcaagacctcgtaaatcctcttttggattcgtacctttctactccgatgaagaaattcaacaagcttttgttgaagattttgattccaaagaagagcagctgtacaaaacgagcgcacagagtacctctttccgaaatatcactttcgctacagatagttattctattaaaggagaggataacctcacgattcttgcaagcttagttcgtcatttgcataaatctcctaaagctacgctatatatagagggccatacagatgaacgtggagctgcagcttataacctagctttaggagctcgtcgtgcgaatgctgtaaaacaatacctcatcaaacagggaatcgctgcagaccgcttattcactatttcttacggaaaagaacatcctgttcatccaggccataatgaattagcttggcaacaaaatcgtcgtactgaatttaagatccatgctcgctaa

SEQ ID NO: 175 - protein, 431 aa, Chlamydia trachomatis
MKGSVVFLRSLLCLLCLLPSTLHCEDLEIHVRSESSLLPIAVSLLSSPKDSRQASYLASLRDLFARDLALGDLLAPTKELAPQTIFLEASYPELIFSLKKEGKGSQKIFSLELSGDPSKDHQAIHEAADRIHFLLTRVPGISSGKIIFSLCATNSSTELKQGELWSVDYDGQHLYPLTNEHSLSVTPTWMHISHIPAYMYVSYKLGVPKIFLNTLNQPAGKKLLAMQGNQFMPTFSPKTKLLAFISDRDGNPDLFVQSFSLATGAIGTPKKLLNEAFGTQGNPSFSPDGTRLVFVSNKDGTPRIYQMQISPEQHSPRLLTKKYRNSSCPTWSPDGKKIAFCSVIKGVRQICVYDLASGRDEQLTTSTEHKESPSWAADSNHLVYSAGSSNTSELFLLSLITKKSRKIVIGSGEKRFPCWGAFPSQHIKKTS

SEQ ID NO: 176 - DNA, 1296 bp, Chlamydia trachomatis
atgaaaggctccgttgtgtttctccgttctcttctctgtctactttgtcttctcccttccactctccactgtgaagatttggaaattcatgtacgatcagaaagctctctccttccaatcgcagtctctttgctctcatcaccaaaagactctcgtcaagcttcctatcttgcatccctccgagacttatttgctcgcgatttggctttaggagacctgttggcgcctacaaaagagctggctccgcaaacgatctttatagaagcgtcctatccagaactgattttttctttaaaaaaagagggtaaaggatctcaaaaaattttctctctagagctctctggagatccttctaaagatcatcaagcgattcatgaggctgcagatcgcatccattttcttcttacacgcgttcctggaattagctcaggaaaaattattttttccctatgtgctacaaactcttccacagaattaaaacaaggggaactctggtccgttgattacgatggacaacatctttacccacttaccaatgaacattccttatctgtaactccaacctggatgcatatcagtcacattcccgcttatatgtatgtttcctacaaattaggggtcccaaaaatctttctgaatactctgaaccagcctgcagggaaaaaaatccttgctatgcaagggaatcagtttatgccgactttctctcctaaaactaaactcctcgcctttatttctgatagagacggcaatcctgatctttttgtacaatcattctcactagctaccggagcaattggcacaccaaaaaaactcctaaatgaagcttttggaacacaaggaaacccttcctttagccctgacggcacccgtttagtttttgtttctaacaaagacggaacgcctcgtatttatcagatgcaaatctctcccgaacaacattctcctcgcttactaacaaaaaaatatcgaaatagcagttgcccaacatggtctccagatggtaaaaaaatagccttctgctcagtcattaaaggtgtccgtcagatttgtgtgtatgatctggcttcaggaagagatgagcaattaactacatctactgaacataaagaaagcccttcttgggctgcggatagtaaccaccttgtttatagtgccggatcttccaatacatccgaactattcctgctgagcctaattaccaaaaaaagtaggaaaattgttataggatcaggagagaaacgtttcccatgctggggagcatttccttcacaacatataaagaaaacctcatga

SEQ ID NO: 177 - protein, 235 aa, Chlamydia trachomatis
MPKFQYAPFLCTSIIIHIALGGMLFFSAPQKKKPRLSPFKERIVALPPEPKITTTLQTPSPQPIRKPVKNAPAPEKKAAKPPAISNPQKSPQKPNKASPTPRNETLEKKQATLKKLAQLANQLAEEAETQESYIAQFSWPAQAQVLTENTSYQQDAFCALFQQYVSLPFPGEVRLKLEFSSEGALLHCSILSTISHADKQHILNQIQKIPFQSFFSAYKTSKNIVFHIRLQGNSA

SEQ ID NO: 178 - DNA, 708 bp, Chlamydia trachomatis
atgccaaaatttcaatatgccccttttctttgcacttctataatcatccatattgctcttggaggaatgctctttttctccgcgcctcaaaaaaagaagcctcgtctctccccttttaaagaacgtatcgtcgccctaccccctgaacctaaaatcactaccactttacagactccctctccacaacctattcgtaaaccggtaaaaaacgctccagctcccgagaaaaaagctgcaaaacctcccgcgatctctaaccctcaaaaatctcctcaaaaaccaaacaaagcgagtcctacgccgcgtaatgagacactagagaaaaaacaagctactctcaaaaaattagctcaactagctaatcagctggccgaagaggctgagacacaagaatcctacatcgcacaattttcttggcctgctcaagcgcaagttcttactgaaaacacatcctatcagcaagatgccttctgtgctttatttcagcagtacgtgagtcttcctttccctggagaggttcgcctaaaactagaattttctagtgaaggcgctcttctccattgctcaatcttatctactattagccatgctgataaacaacatatcctgaaccaaattcagaaaattccttttcaatctttctttagcgcatacaaaacctcgaaaaatatcgtttttcatattagactgcagggaaattctgcttga

SEQ ID NO: 179 - protein, 135 aa, Chlamydia trachomatis
MKRFVYEDLEEDPSVSLTPLIDIVFVILMAFMIAMPLIKIDRISLATGSSSHQAFKKQESQQAEIKVFRNHTITLNDLPMSLQELRSQLTVLHAQHPNIVPLLLQDGDTAFKLYQEIKSTIEEAGFQELHIALKN

SEQ ID NO: 180 - DNA, 408 bp, Chlamydia trachomatis
atgaaacgcttcgtttacgaagatctagaagaagaccctagtgtcagtcttactcctctgatcgatatcgtctttgtaattttgatggcgttcatgatcgccatgcctcttattaaaattgatcgtatctctttagccacaggatcttcctcacaccaagcctttaaaaaacaagagtctcagcaagctgaaattaaagtgtttcgaaaccataccattactctcaatgaccttcctatgtctctccaagagttacgctcgcaactaacagtcatccatgcgcaacaccctaatatagttccgctgctcttacaagacggtgatacagctttcaaactgtatcaagagatcaaatcgactatcgaagaagccggatttcaggaacttcatattgctttgaagaactaa

SEQ ID NO: 181 - protein, 232 aa, Chlamydia trachomatis
MFQLANNPIIQSFQEADLFGKVIFFSLFALSICTWTVLHQKLSIQKKFLKSGKSLKEFLIKNRHSPLSLDIHPESTPFTDLYFTIKRGTLELLDKNRQLAPERTPLLSVEDIQSLETLFNAVMPKYRALLNKNNFIPATTISLAPFLGLLGTVWGILLAFAHISTGQANGTIMMEGLATALGTTIVGLFVAIPSLVGFNYLRAHAFQVSLEIEQTAFLLLNSIEVKYRQTSL

SEQ ID NO: 182 - DNA, 699 bp, Chlamydia trachomatis
atgttccaactcgcaaataatcccatcattcagtcctttcaagaagccgatctttttggaaaggtcattttcttttcgctgttcgctctttcgatatgtacatggacagtccttcatcagaaactctccattcaaaagaaatttctaaaatcagggaaatctttaaaagagtttttaataaaaaatcgtcattctcctctctccttagatattcatcctgaatccacgccttttacagacctctattttactatcaaacgtggaaccctggaattactagataagaatagacagttggctccagaacgaactcctttgctttccgtggaagatattcaatcgttggaaacgctttttaatgcagtgatgccgaaatatagagctctcttaaataaaaataacttcattccagcaacgaccattagtctcgctccttttctaggactattagggaccgtttgggggattctattagcttttgcgcacattagtaccggacaagccaatgggacgatcatgatggaaggcttagcaacagcattaggaacaactattgtagggctatttgttgccatcccctcactagtaggtttcaattatctacgcgcccacgccttccaagtctctctggaaatcgagcaaactgcttttcttttacttaactctattgaagtcaaatatcgacaaactagcttatga

SEQ ID NO: 183 - protein, 954 aa, Chlamydia trachomatis
MSRLDVSVFDSLANKEKASLLEEVLCGENLQDFTTYSKVALAKKNLAIARKLASYILNEEGDLELSRVVESIQLLTKCLYPLGPYRQEEGPIREHVLKMLEFLRDDQEIKNRFRRFFVPSYARVQDLIRNTLALPASETVTVRHVREAALVALFTYLRQDVGSCFATALAILIHREYPLLFIRDLEDLLSSGKISRIVGDREISVPINLLPCVGDLFKPICVMDLYPNPVATLAASSDLQAAFVASGIFPTTGDIAGEVQTLLANEFIYQKVQDIHGKITAHDVIQDSLLHHYQLSLSTVQASVLQEGFRKERGDGTVLLSTNSQRVLSYLESHEQAKLGFIRDTQNVLLKSWEYTLATLADASQTTTTKHLQIALGWTSDDEDGLREIIRRFLAEEVATTQAFAGQCEETYQEAKAQLEHVESRMRNPINKQDSQLLAMDHVRFRQELNQALQDWNAAQEKLKKMIMLPDFLLSFYSREIPNYFRSVYDAFIREFSGNYQDVPAGFRILFTYGRSHPNTWEPIYSIEEFLHALTEFFTSIEGDLLAKHNVSGLEKETSILLHRIVSALHEPRFQEAAMERILKAYNCPIPQGIFQHLDQVTHTPWVYVSGGTVTTLVGDYFENSKPLVKLEKLPADPHELAAFFADALKDLPEAVKDYVENGDHSLLAAAPSHVFSVMAGAPLFRDAWTNDWYSYTWLRDVWLSKHQDFLKRTLFDKSAIYAFITRFCTRYYLQELTQDFLYFCDDLSLSIPEFYEKSSRFFQSTVHDEKVVATLQKYLASQFVHEAPYVSEQQLPQIISDLSSYLGISSRISYDRFATLLEENVGKHSLLSSSDLRHLYKGLLMAGYQRVYHEEDLSMRLLAAMRHYGLAYPAPLLFGDTNWAYRYFGFILHPGTQEMDLWEFNYLGLVGRPSENKERWFVVRDPWALYPNPIDYGMAPPPGYRSGLPKGFF

SEQ ID NO: 184 - DNA, 2865 bp, Chlamydia trachomatis
atgtctcgtttggacgtttctgtatttgattccttagctaataaagaaaaagcttccttactggaggaggttttgtgtggtgagaacctgcaagatttcacaacgtatagcaaagttgctttagcaaaaaaaaatcttgctattgcaaggaagttagccagttatatcctgaatgaagaaggagatttggagcttagtcgagttgttgaaagtattcagctgttgacgaaatgtttatatcccttaggaccgtatcgccaggaagaagggccgattcgtgagcatgtattaaagatgctggagtttttacgggatgatcaagaaattaaaaatcgttttcgaaggttttttgtaccttcttacgctagagttcaagatttaattcggaatacgttagcgttgcccgctagtgagacagtaaccgtacggcatgtacgtgaagccgctttagtcgcattatttacctatttgcgacaagatgtcggatcttgtttcgcaacagcattagcaattcttatccatcgggagtatccattattatttattcgtgatttggaagatttattatcttccgggaaaatatcccgtatcgttggtgatcgagagatttccgttccgatcaatcttctaccgtgtgtaggagatttatttaagcctatttgtgtaatggatttatatcccaatcctgtggctactcttgctgcttcgtcagatttacaagcagcattcgtagcttctggcatatttccaacaacaggggatatcgcaggtgaggtgcaaacgctactagctaatgagtttatctatcaaaaagttcaggatattcatgggaagataacagctcatgatgtcattcaggatagtttgttacatcactatcagctttctctttctacagtgcaagcttccgttttgcaggaaggtttccgtaaagagcgaggggatggtacggttttgttgtctacgaatagtcaacgtgtacttagctatttagaatctcacgagcaagcaaaactgggatttattcgtgatacacagaatgtattattgaaatcgtgggaatatacgttagcaacgttagcagatgcgagtcaaacaacaaccaccaagcatttacaaattgctttaggttggaccagtgatgatgaggatggtttacgtgaaattatacgtagatttttagcagaagaagtagctacgacacaagcctttgcaggacaatgtgaagagacgtatcaagaagcaaaagcgcagttagaacatgtggaaagtcggatgcgtaatccgatcaataaacaagatagccaaattctggctatggatcatgtgcgttttcgacaagaattgaatcaagctttacaagattggaatgctgcgcaagagaagctgaaaaaaatgatcatgctaccagactttctcttgtctttttattcacgagaaatccctaactatttccgtagcgtatacgatgcttttattagagagttttctgggaattatcaagatgttcctgcgggctttcgtatattatttacctatgggaggagtcatcctaacacgtgggagccgatttattctatcgaagaatttattcatgctttgacggagttttttacttctatagaaggagatctcctagcgaagcataatgtttctggattagaaaaagaaacttctattcttttgcatcgtattgtatcggctttacatgaacctcgttttcaggaggctgcaatggaaaggatcttgaaagcttataattgtcctattccacaggggattttccagcatttagatcaagttacgcataccccttgggtttatgtttctggaggaacagtaacgactttagtaggcgattattttgaaaattcgaaaccactcgtcaaactagaaaaattgcctgcggatccgcatgagttggcagcattttttgctgatgcattgaaagatcttcctgaggctgtgaaagattatgtagaaaatggggatcattctttattagcagcagccccttcgcatgtgttttctgttatggcaggagctccgttatttagagatgcatggactaatgattggtatagctatacttggctgagagatgtgtggctttctaagcatcaggattttttgaagcgtactcttttcgataaatcggcaatatatgcgtttattacacgtttctgtacacggtattatctccaagaacttacccaagatttcttatatttttgtgatgatctctcgttatctattcctgaattctatgaaaagagctcgcgtttctttcagtcgactgttcatgatgagaaagtagtagctactttacagaaatatttagcgagccagttcgtacatgaagcgccttatgtttctgaacagcagttaccccagattatcagtgatctttcttcttatttagggatttcttctcggatatcctatgatcgattcgctaccctactagaagagaatgtagggaagcattcgctattatcttcctcggatctcagacatctgtataaaggtttattaatggctgggtatcagcgtgtttatcatgaagaagatctttctatgaggctgattgctgctatgcgtcactatgggttagcctatcctgctccgcttctttttggtgatacgaattgggcttaccggtattttggttttattttgcatcctggaacccaagagatggatttgtgggaatttaattatttaggattggtaggacgtccttcagaaaataaagaacgatggtttgttgttcgagatccttgggcgttgtatccgaatcccatagattacggaatggcccctccaccaggctatcgaagtggattgccgaaaggctttttttag

SEQ ID NO: 185 - protein, 602 aa, Chlamydia trachomatis
MRLTFTKRILLFLFLVIPAPLLLNLVVLSFFSFVAVKTTIIQDLHTRTMNFNLELEKKIAIQNIFLKRLAETLALKTLTTSHDFFTEAYSEMIALGDTDLSLCLLSSANDSIRTKNPRDPFVRYLKAHPEIRDKLIQNPGNASLISISERPDTEDHYLIFAEPLPIYEDPSLAGWVIAFYSMQKLRNYLFHNKQSYQDLLCYLNHKGELLFSNSSPFQNGAFSLSMEGYPALSSEKASYPLEPSPELFKAKELLKVSIHGKTFLAYLSPWQPIPHTHSLALIPLSTCITQALRLPINVILFYLLAFSLMGWVLSCTSKRLNRPLQELSVSMESAWKGNHNVRYEPQPYGYEINELGNIFNCTLLLLLNVKEKAEIEYISGNLLQKELALLSSLKDTLLCQRSNSLPGGTFSLHYLQGEQQTGYFYGWVATPEKDRLFGVIGIAGDIGLPSYLYALSARSLFLTYASLGYSLPSICHKTMRSFDETTVGNEASISIACLEYDLSSKSLSVLTEGANPPTLFIKRQEHLLTMSEQQRIETGDILVCLTGGPHIIQYLKTLPIEALLKDPLAPLNSENFAEMLTTMLRNKNQTQIDGAVGFLSFI

SEQ ID NO: 186 - DNA, 1809 bp, Chlamydia trachomatis
atgagactgacattcaccaaaagaatccttctttttcttttcctagtgattcctgctcctctccttctcaatctcgttgtcctttctttcttttccttcgtggctgttaaaacaacgatcattcaggatctgcatacccgcaccatgaactttaatttagaactcgaaaagaaaatcgctattcaaaatatttttctgaaacgtttagcggaaacgttagcattaaaaaccctcacaacctcacatgattttttcactgaagcttatagtgagatgattgctctcggagataccgatttatccctctgcctactttcttccgctaacgatagcatccgtacaaagaatcctcgggatccttttgttcgttatataaaagctcatccagaaatacgtgataagcttatccaaaatcctgggaatgctagccttatctctatttctgaacgcccagacaccgaagatcattaccttatttttgcagaaccacttcctatctacgaagacccctcattagccggctgggtaattgctttctattcgatgcaaaaactacgcaactatctcttccataacaaacaatcctatcaagatcttctttgctatctcaaccataagggagaacttctcttttcaaactcatctccttttcaaaatggagctttttctctctccatggaaggatatcccgctctctcttcagaaaaagcttcttatcctttagaaccttctcctgaattatttaaagctaaagagctgttaaaagtttccatacacgggaaaactttcttagcctatttatctccttggcagcctataccacatacccattctcttgcgctgatccctctatccacttgcattacacaagccttacggcttcccatcaacgtaatcttattctatatcctcgctttttctttgatgggatgggtgctctcttgcactagcaaacgattaaatcgtcccttacaagagctttctgtcagtatggaatccgcgtggaaaggcaaccataatgtccgctatgagccgcaaccttatggctatgaaatcaatgaactggggaatatttttaactgtactttacttcttctgctgaacgtcaaagaaaaagctgaaatagaatatatttccggaaatttattacaaaaagagcttgctcttctctcttccttaaaagatacccttctctgtcaacgttcgaattctctcccaggaggaactttctctttgcattatttacaaggagaacaacaaaccggatatttttatggttgggttgccactcctgaaaaagatcgcctcttcggagtgattggaatagctggagatatcggactgccttcttatctctacgcactctctgcccgcagtttattcctaacgtatgcaagtttaggctactcattaccttctatttgccataaaacgatgcgaagctttgatgaaacaactgtaggcaatgaagcttctatttctatagcttgtcttgaatacgacctttcttccaagtcattgtctgttctaacagaaggtgctaatcctccaactctattcataaaacgacaagaacatctcctcacgatgtcagaacaacaacgtattgagaccggagatatccttgtttgccttactggagggccccacatcattcagtacttgaaaacactccctatagaagcattactaaaagatcctctcgctccactcaattctgaaaactttgcagagatgttaacaacgatgctgagaaataaaaatcaaacgcagatcgatggagctgtaggctttttatcctttatctaa

SEQ ID NO: 187 - protein, 442 aa, Chlamydia trachomatis
MQAAHHHYHRYTDKLHRQNHKKDLISPKPTEQEACNTSSLSKELIPLSEQRGLLSPICDFISERPCLHGVSVRNLKQALKNSAGTQIALDWSILPQWFNPRVSHAPKLSIRDFGYSAHQTVTEATPPCWQNCFNPSAAVTIYDSSYGKGVFQISYTLVRYWRENAATAGDAMMLAGSINDYPSRQNIFSQFTFSQNFPNERVSLTIGQYSLYAIDGTLYNNDQQLGFISYALSQNPTATYSSGSLGAYLQVAPTASTSLQIGFQDAYNISGSSIKWSNLTKNRYNFHGFASWAPRCCLGSGQYSVLLYVTRQVPEQMEQTMGWSVNASQHISSKLYVFGRYSGVTGHVFPINRTYSFGMASANLFNRNPQDLFGIACAFNNVHLSASPNTKRKYETVIEGFATIGCGPYLSFAPDFQLYLYPALRPNKQSARVYSVRANLAI

SEQ ID NO: 188 - DNA, 1329 bp, Chlamydia trachomatis
atgcaggctgcacaccatcactatcaccgctacacagataaactgcacagacaaaaccataaaaaagatctcatctctcccaaacctaccgaacaagaggcgtgcaatacttcttcccttagtaaggaattaatccctctatcagaacaaagaggccttttatcccccatctgtgactttatttcggaacgcccttgcttacacggagtttctgttagaaatctcaagcaagcgctaaaaaattctgcaggaacccaaattgcactggattggtctattctccctcaatggttcaatcctcgggtctctcatgcccctaagctttctatccgagactttgggtatagcgcacaccaaactgttaccgaagccactcctccttgctggcaaaactgctttaatccatctgcggccgttactatctatgattcctcatatgggaaaggggtctttcaaatatcctatacccttgtccgctattggagagagaatgctgcgactgctggcgatgctatgatgctcgcagggagtatcaatgattatccctctcgtcagaacattttctctcagtttactttctcccaaaacttcccaaatgaacgggtgagtctgacaattggtcagtactcactctatgcaatagacggaacattatacaataacgatcaacaacttggattcattagttacgcattatcacaaaatccaacagcaacttattcctctggaagtcttggagcttacctacaagtcgctcctaccgcaagcacaagtcttcaaataggatttcaagacgcttataatatctccggatcctctatcaaatggagtaaccttacaaaaaatagatacaattttcacggttttgcttcctgggctccccgctgttgcttaggatctggccagtactccgtgcttctttatgtgactagacaagttccagaacagatggaacaaacaatgggatggtcagtcaatgcgagtcaacacatatcttctaaactgtatgtgtttggaagatacagcggtgttacaggacatgtgttcccgattaaccgcacgtattcattcggtatggcctctgcaaatttatttaaccgtaacccacaagatttatttggaattgcttgcgcattcaataatgtacacctctctgcttctccaaatactaaaagaaaatacgaaactgtaatcgaagggtttgcaactatcggttgcggcccctatctttctttcgctccagacttccaactctacctctacccagctcttcgtccaaacaaacaatctgcccgtgtttatagcgtgcgagctaatttagctatctaa

SEQ ID NO: 189 - protein, 424 aa, Chlamydia trachomatis
MFDVVISDIEAREILDSRGYPTLCVKVITNTGTFGEACVPSGASTGLKEALELRDKDPKRYQGKGVLQAISNVEKVLMPALQGFSVFDQITADAIMIDADGTPNKEKLGANAILGVSLALAKAAANTLQRPLYRYLGGSFSHVLPCPMMNLINGGMHATNGLQFQEFMIRPISAPSLTEAVRMGAEVFNALKKILQNRQLATGVGDEGGFAPNLASNAEALDLLLTAIETAGFTPREDISLALDCAASSFYNTQDKTYDGKSYADQVGLLAELCEHYPIDSIEDGLAEEDFEGWKLLSETLGDRVQLVGDDLFVTNSALIAEGIAQGLANAVLIKPNQIGTLTETAEAIRLATIQGYATILSHRSGETEDTTIADLAVAFNTGQIKTGSLSRSERIAKYNRLMAIEEEMGPEALFQDSNPFSKA

SEQ ID NO: 190 - DNA, 1275 bp, Chlamydia trachomatis
atgtttgatgtcgtcatctccgatatagaagcgagagaaattttagattctcgaggctatcccacattatgtgttaaagtcatcactaatacaggaacctttggtgaagcgtgcgttccttctggagcatctacaggcatcaaggaagctttggaactgcgtgacaaagatcctaaacgttaccaagggaaaggggtcttacaagccatttctaatgtcgaaaaagtgctgatgcccgctttacaaggattcagcgtatttgaccaaattacagctgatgcgattatgattgatgctgatggaactccgaacaaagaaaagttaggagctaatgcgattcttggagtctccctagcattagcaaaagctgctgcaaatactttacagagacctttatatcggtatcttggtggatctttctcgcatgtgcttccttgccctatgatgaatcttatcaatggcggtatgcatgctacaaatggtctccaattccaagaatttatgattcgtccaattagcgctccttctctaacagaggctgtgcggatgggagcagaagtcttcaacgccttaaaaaaaatcttacagaatcgacagctggctacaggtgttggtgatgaaggcggatttgctcctaatcttgcctctaatgccgaagctctggatctactcttaacagcaatcgaaactgcaggattcacacctagagaagatatttctttagctctcgactgcgctgcttcttctttctataatacccaagataaaacctatgatgggaaatcgtatgcagatcaagtgggtatacttgcagaactctgtgagcactatcctatagattctatcgaagatgggctagccgaagaagattttgagggctggaaactcctatccgagactttaggagatcgtgtgcaactagttggagacgacctatttgtgacgaattctgcattgattgctgaaggaatcgctcaaggacttgccaatgccgttctcatcaaaccaaaccaaattggaacacttacagaaactgcagaagctattcgtttagcaactatacaaggctacgctaccattctttcgcatagatcaggagaaacagaagatactaccatagcagaccttgctgtcgcttttaatacaggtcagattaaaacagggtctctttcccgttctgagcgtatcgctaagtataaccgtctaatggcaattgaagaagagatgggtccagaagctctattccaagattcaaatcccttttctaaagcatag

SEQ ID NO: 191 - protein, 760 aa, Chlamydia trachomatis
MKNILGYGFLGTFCLGSLTVPSFSITITEKLASLEGKTESLAPFSHISSFNAELKEANDVLKSLYEEALSLRSRGETSQAVWDELRSRLLGAKQRIRSLEDLWSVEVAERGGDPEDYALWNHPETTIYNLVSDYGDEQSIYVIPQNVGAMRITAMSKLVVPKEGFEECLSLLLMRLGIGIRQVSPWLKELYLTNREESGVLGIFGSRQELDSLPMTAHIAFVLSSKNLDARADVQALRKFANSDTMLIDFIGGKVWLFGAVSEITELLKIYEFLQSDNIRQEHRIVSLSKIEPLEMLAILKAAFREDLAKEGEDSSGVGLKVVPLQNHGRSLFLSGALPIVQKAIDLLRELEEGIESPTDKTVFWYHVKHSDPQELAALLSQVHDIFSNGAFGASSSCDTGVVSSKAGSSSNGLAVHIDTSLGSSVKEGSAKYGSFIADSKTGTLIMVIEKEALPKIKMLLKKLDVPKKMVRIEVLLFERKLSNQRKSGLNLLRLGEEVCKQGTQAVSWASGGILEFLFKGGAKGIVPSYDFAYQFLMAQEDVRINASPSVVTMNQTPARIAIVEEMSIVVSSDKDKAQYNRAQYGIMIKILPVINIGEEDGKSFITLETDITFDSTGRNHADRPDVTRRNITNKVRIQDGETVIIGGLRCNQTMDSRDGIPFLGELPGIGKLFGMDSASDSQTEMFMFITPKILDNPSETEEKLECAFLAARPGENDDFLRALVAGQQAAKQAIERKESTVWGEESSGSRGRVEYDGRE

SEQ ID NO: 192 - DNA, 2283 bp, Chlamydia trachomatis
gtgaaaaatattttgggctatgggtttctagggactttttgtttgggaagtttgacggttcctagtttttccatcacgattacagaaaaattggcttctctagaaggaaaaacggaatcgctagcccctttttcgcatatttcatcttttaatgctgaattgaaagaggcaaatgatgttctcaaatctttatacgaagaagctttgtctctccgttctcgaggagagacttcgcaggcggtatgggacgagttgcgaagccgattgatcggcgctaaacaacggatacgttcattggaagatttatggtcagtagaggttgcagaaagggggggggatcccgaagactatgccctttggaatcatccagaaactacgatttataatctggtcagtgattacggagatgaacagagtatctatgtgattcctcaaaatgttggggcgatgcgtatcacagccatgtctaagctagtggtccctaaagaaggatttgaggaatgtttgtctttgcttttaatgcggctgggtattgggatcagacaggttagtccttggattaaggagctgtatttaactaatagggaagagtctggtgttttaggtatctttggatctagacaagagctagatagcttgcctatgacggcacatattgcttttgtactttcttctaaaaatttagatgcacgagcggatgtacaagctttgcgcaagttcgcaaatagcgataccatgttaattgattttataggggggaaagtttggttatttggagctgtcagcgagattaccgagctccttaaaatctatgaattcttacaatcagacaacattcgacaagagcatcgcattgtttctttatcaaaaatagaacccttagaaatgctggctattttgaaagcagctttccgagaagatttagctaaagagggagaagattcttctggagtgggattaaaagtggtccctttacaaaaccatggacgctcgcttttcttaagtggagctcttcccatcgttcagaaggcaatagatcttattcgggaactagaagaggggatagagagccctaccgacaaaacggtattttggtatcatgtcaaacactcagatcctcaggagcttgcagcgcttctttctcaagtacatgatattttctcaaatggtgcttttggggcatctagtagttgtgatactggcgtagtctcaagtaaagcgggatcctcttcgaatggattagcggtacatatagatacgtcgctggggagctccgtaaaagaaggttctgcgaaatatgggagttttattgcagattccaagaccggaaccttgattatggttattgagaaagaagctttacccaagatcaagatgttgttgaagaaactggatgtgcccaaaaaaatggtacgtatagaggttctgctttttgaaagaaaactatccaatcaacgtaaatctggattgaacctattgcgtttaggagaagaggtttgtaagcagggaacgcaagccgtttcgtgggcaagtgggggcattctggagttcctgttcaaaggtggagcaaaagggattgttcctagttatgactttgcttatcagtttctcatggcgcaagaggatgtccgtattaatgcaagtccttccgtcgtgactatgaaccaaaccccggcgagaattgcgattgtggaagaaatgtcaattgtagtttcttctgataaggataaagcccaatacaatcgagctcaatacgggattatgattaagattcttcccgttattaatatcggagaagaggatgggaagagctttattactttagagaccgacatcacgtttgattcgactgggagaaatcatgcggatcgtcccgatgttacacgcagaaatattacgaacaaggttcggattcaagatggcgaaacggtcattattggggggcttcgttgtaatcaaactatggattctcgtgacgggattccatttttaggagagttgccaggaataggaaaattatttggtatggattctgcttcggactcacaaacagagatgtttatgtttatcactccgaagattttggataatcctagtgagacagaagaaaaattagaatgtgctttcctggctgctcgccccggggagaacgatgatttcctcagagctttagtagcaggacagcaggctgctaaacaggctatagaaagaaaagagtctaccgtatggggagaagaatcctccggctctcgaggaagggtggagtatgatggacgggaataa

SEQ ID NO: 193 - protein, 109 aa, Chlamydia trachomatis
MMVVITLIGIIGGALAFNMRGSLQKGKIFQTEQNCARVYDVLMMEYASGNLSLKEVIANKEAILEDSAWCKEGKKLLKDAWGEDLLVKMNDKGDDIVVFSKKVRNEQRG

SEQ ID NO: 194 - DNA, 330 bp, Chlamydia trachomatis
atgatggttgtcattaccctcattggtattattggtggagccttggcttttaatatgcgagggagtttgcaaaaagggaaaatcttccaaacagagcaaaattgcgctcgcgtgtatgacgtccttatgatggaatatgcttccggaaatttgtctctaaaagaggtcatcgcaaataaggaagcgattttagaagattctgcgtggtgcaaggaaggaaagaaacttcttaaagatgcttggggagaagatcttcttgttaaaatgaatgacaagggtgacgatattgttgtgttctctaagaaagtaaggaatgaacagcgagggtaa

SEQ ID NO: 195 - protein, 174 aa, Chlamydia trachomatis
MFRKIKKKRAFLLSELLIACVLISLLLGSLGYWTRRIWISHKEKEHVYRIFLNESKTYRFLRGTFLSTIAMEAQEELVFSFDRGVYVDPHLAGVVQGTLHYDPITQEISLLVASEREEARQEKISLWTHVLSMEWRVLRYQGLGEGPDRVYLTLVRKVGALPPRTLSYIFAVGR

SEQ ID NO: 196 - DNA, 525 bp, Chlamydia trachomatis
atgtttagaaagataaaaaagaaacgagcatttttactttcagaacttctcatcgcttgcgtgcttatcagtttgctgctcggctctttagggtattggacacggaggatatggatatctcataaagagaaagagcacgtgtatagaatctttctcaatgagagcaagacgtatcgatttttaagaggtacctttttatccactattgccatggaagctcaggaagagttagttttttctttcgatcggggagtgtatgtcgatcctcacttagcaggtgttgtgcaagggacgttacactatgaccccatcactcaggaaatttctctaatagtagcgagtgaaagagaggaggcccgtcaggagaaaatttccttatggacgcatgttctttctatggaatggaaagttcttagatatcaaggtctaggagagggaccagatagagtgtacttaacactagtaaggaaggttggggccttgccaccaagaaccctttcctatatttttgctgtgggtagatag

SEQ ID NO: 197 - protein, 330 aa, Chlamydia trachomatis
MHFIFTLLCLTSLVTVVSLDAAGTRKRISYAKLQEKEEVAFSAQQSAISEVIYRDKTKRLSSQAKRAEPRTQDKERDSVVVRQKRYRLLEIPFSRPPNNSRFNLYSLLKESPENYGDPSSAYAIFARLLQGLYVQSELIPQGAEYRVIEALLAQKDEIISRAQELGSDCLETVVLPEEEAGWLYKMLKGTKTTRSLLHFLNYEEKNTNQGRLNLLFTDPVILQAFINDSKAYSELERVRQEVWESARQQELAIKAYGQAAALEIFKTRTDFRTELQDKTQVILHRYDLLSLLNKKVFDYTLGTAGDYIFVVDPENEGVNRSRCVSRRKTN

SEQ ID NO: 198 - DNA, 993 bp, Chlamydia trachomatis
atgcattttattttcacactactatgtttaacctcgttggtgaccgtggtatctttggatgctgccggaactcgtaagagaatttcctatgcaaaacttcaagaaaaggaagaagtagctttttctgcgcaacaatctgctatttctgaagtgatctacagagataaaacgaaacgattgtcttcccaggcgaaaagagcagagcctcgtacgcaagataaggagcgtgatagtgtcgttgttcggcagaagcgctatcgactgttagaaatccctttttctcggccgccaaataattctaggttcaatctttattctttgctgaaagagtctccggagaattatggagatccttcttcagcatatgctatttttgctaggttgctacaaggactgtatgtgcagtcagagctcattcctcaaggtgcggagtatcgtgttatagaggctttgcttgctcaaaaggatgagattatttctcgagctcaagagcttggttcggattgtcttgagacggtagtcctccctgaagaggaagccggttggttgtacaagatgctaaaaggcactaagacaacgcgttctttattgcattttctcaactatgaagagaaaaataccaatcagggtaggttgaatttattgttcacagatcccgttattcttcaagcatttatcaatgattctaaagcttattctgaattagaacgtgtacggcaagaggtttgggagagcgcgcgacagcaggagttggctattaaagcttatgggcaagctgctgcattagaaatttttaaaactagaacggatttccgcacagagttgcaagacaaaacgcaggtaattctccatcgatatgatcttctttctttactgaataagaaggtttttgattacacattagggactgctggggattatatttttgtggtagacccagaaaatgaaggggttaacagaagtcgttgcgtttcaagaagaaaaactaattaa

SEQ ID NO: 199 - protein, 326 aa, Chlamydia trachomatis
MFRYTLSRSLFFILALFFCSACDSRSMITHGLSGRDANEIVVLLVSKGVAAQKVPQAASSTGGSGEQLWDISVPAAQITEALAILNQAGLPRMKGTSLLDLFAKQGLVPSEMQEKIRYQEGLSEQMATTIRKMDGIVDASVQISFSPEEEDQRPLTASVYIKHRGVLDNPNSIMVSKIKRLVASAVPGLCPENVSVVSDRASYSDITINGPWGLSDEMNYVSVWGIILAKHSLTKFRLVFYFLILLLFILSCGLLWVIWKTHTLISALGGTKGFFDPAPYSQLSFTQNKPAPKETPGAAEGAEAQTASEQPSKENAEKQEENNEDA

SEQ ID NO: 200 - DNA, 981 bp, Chlamydia trachomatis
atgtttcgttatactctttctcgatccttatttttcattttggctcttttcttctgctcggcttgtgatagtcgttccatgattacacacggcttgtcaggacgtgatgctaatgaaatcgtagtgcttctagtcagtaaaggggtcgctgcacagaaagttccccaagcagcgtcctcaacaggaggatctggagaacaactctgggatatttcggttcctgcagcacaaattacagaggctctagctattctgaaccaagctgggcttccaagaatgaaaggaaccagccttcttgatctattcgctaaacaagggctggtcccttctgaaatgcaagaaaaaatccgctaccaagaaggtctttcagaacaaatggctacgaccattagaaagatggacggtatcgtcgatgcgagcgtacagatttccttttctcctgaagaagaagatcaacggccgctaacagcctctgtatatatcaaacacagaggggtattagacaaccctaacagtattatggtgtctaagattaaacgtttagttgcgagtgctgtcccaggactatgtcccgagaacgtttccgtagtcagtgaccgagcttcttatagtgacattactattaatggcccttggggactctccgatgaaatgaattatgtttctgtatgggggatcattctagctaagcattcccttactaaattccgccttgttttctatttcttaattctccttctcttcattctttcctgtgggctactctgggtcatttggaaaacacacacactgatttctgctctgggtggaacaaaaggattctttgatcctgctccttactcacagctctctttcactcagaataagccagctccaaaagaaactcctggagcagcagaaggtgcagaagcgcaaaccgcttcggaacaaccctctaaagaaaacgcagaaaaacaagaagagaataacgaggacgcttaa

SEQ ID NO: 201 - protein, 340 aa, Chlamydia trachomatis
MSSKLVNYLRLTFLSFLGIASTSLDAMPAGNPAFPVIPGINIEQKNACSFDLCNSYDVLSALSGNLKLCFCGDYIFSEEAQVKDVPVVTSVTTAGVGPSPDITSTTKTRNFDLVNCNLNTNCVAVAFSLPDRSLSAIPLFDVSFEVKVGGLKQYYRLPMNAYRDFTSEPLNSESEVTDGMIEVQSNYGFVWDVSLKKVIWKDGVSFVGVGADYRHASCPIDYIIANSQANPEVFIADSDGKLNFKEWSVCVGLTTYVNDYVLPYLAFSIGSVSRQAPDDSFKKLEDRFTNLKFKVRKITSSHRGNICIGATNYVADNFFYNVEGRWGSQRAVNVSGGFQF

SEQ ID NO: 202 - DNA, 1023 bp, Chlamydia trachomatis
atgagtagcaagctagtgaactatctccgtttgactttcctatcttttttagggatcgcatctacttcattagacgctatgcctgcggggaatccggcgtttccagtcatcccggggattaatattgaacagaaaaatgcctgttctttcgatttatgtaattcttatgatgtactatccgcactgtccggtaacctgaagctctgcttctgcggagattatatcttttcagaagaagctcaggtaaaagatgtccctgtcgttacctctgtgacaacagctggggttggtccttctcctgatattacttcgacaaccaaaacgcgaaatttcgatctcgtgaactgtaatctcaatacaaactgtgtagctgtagctttttcccttcctgatcgttcgctgagcgcgattcctctgtttgatgtgagtttcgaagtgaaagtaggaggactgaaacaatactaccgccttcccatgaatgcctatcgagacttcacctcggaacctctcaattctgaatcagaagttacggacgggatgattgaagtacagtccaattacggatttgtttgggatgttagcttgaaaaaagtcatatggaaagatggcgtttcctttgtaggcgtcggtgcagactatcgccatgcttcttgccctattgactacatcattgcaaacagtcaagctaatccagaagtattcatcgctgactcggatgggaaactgaacttcaaggagtggagtgtctgcgtaggtcttactacctatgtgaatgactacgttcttccttacttagcgttttctatagggagtgtttctcgccaagctccggacgacagcttcaaaaaattagaagatcgcttcactaacctcaaatttaaagttcgtaaaattaccagctctcatcgtggaaacatctgcatcggagcgacaaactatgtcgccgataacttcttctacaacgtagaaggaagatggggaagccagcgcgctgtgaacgtctccggaggattccaattctaa

SEQ ID NO: 203 - protein, 334 aa, Chlamydia trachomatis
MPVLPRFLKNKIAYTKSLGYLLAAILIGFIMLYKPSSPQPTPTVASTEKKPSHWLKLSHLGNLQSIEIQAKKEQLEKDLTLFEPVLQATVALSQEEDSLAEISVILSLPQASTLSPSLVHSITDYLTRSVPGLTKEHITLSDQHGNLYSPLFEQSNTLLTTSLERSLQTILPQTHFALNYIPVADEGHLQLLVDEDYLNTLPKGARVRLLSHMQEILSAFPEMHPSVDIVPFLKPVAHKTSRLSSIVLSITIVLLSLGILGFATFYLAFHTYDHVSQQKEKIQSINIPKLIEMMKRESPEKVALILSYLDSAKAEELLNKLPEEMKSAVLKLRT

SEQ ID NO: 204 - DNA, 1005 bp, Chlamydia trachomatis
atgccggtgctacctcgctttctaaaaaataagatcgcctacactaaatctttaggctaccttcttgcagctattcttattggcttcatcatgttgtataaaccatcctctcctcagcctacccctactgtagcctctacagagaaaaaaccctcacattggctgaagctctcccatttagggaatcttcaatcgatagaaatccaagcaaagaaagagcaattagaaaaagatctgactctatttgagcctgtgctccaagcaacggttgctctatcccaagaagaagactccttagcagaaatctccgtgatcctttctcttcctcaggcttcgacattatccccatcactcgtgcactcaatcactgattacctgacacgcagcgtccctgggttaactaaagaacatatcaccttgtccgatcagcatggtaatctctactcccctctcttcgaacaaagtaataccctactcactacctcattagaacgctcactacaaacgattcttcctcaaacgcatttcgccttaaactatattcctgtagcggatgaaggccatttgcaacttctcgtcgatgaggactacctcaatactcttcctaaaggtgcacgtgttaagttgctctcgcatatgcaagagattctctcagcattcccagaaatgcatccgtctgtagatattgtccctttcctaaaacccgtagcacacaaaacttctcgcctatcctcaattgtcttgagtattactattgtgttactaagccttggaattctaggctttgctaccttctatcttgcttttcatacctatgaccatgtctctcaacagaaagaaaaaatacagagcataaatataccaaagctgatagagatgatgaaaagagaatccccagaaaaagttgcattgattctctcctatctagactcagcaaaagcggaagaacttcttaataaacttcctgaagaaatgaagagtgctgtgttaaagttaagaacataa

SEQ ID NO: 205 - protein, 174 aa, Chlamydia trachomatis
MLFWGIFSLCLGGLFGGYCRLRYTAKALLLSWRQLLRLALKKREVLQELAALQTFPLLRLEEEIAFLKQGSFYSLKEFLKASDADGVTFYEMERFFTLRLKQTLASLQESLHQEAVQHLMEELLAYENAFSFEAFAFEKAAETYATLHGHPVIQFSGKLFRFPQISFPPLDEAI

SEQ ID NO: 206 - DNA, 525 bp, Chlamydia trachomatis
atgcttttttggggcatttttagtttgtgcttaggagggttattcgggggttattgtcgcttgcgctatacagcaaaggctcttttgttatcctggcgacaactccttcggcttgccttaaaaaaaagagaggttttacaagagatcgcagcgttgcaaacattccctctccttcgtttagaagaggagatagcctttttaaagcaaggctccttctattctttgaaagaatttcttaaagctagtgatgcggatggagttactttctatgagatggaacgattttttactctccgattgaaacagacattagcatcgttgcaagaaagtttgcatcaagaggctgtccagcatttaatggaagaactacttgcgtatgagaatgcgttttcttttgaggcctttgctttcgaaaaagccgcggaaacctatgcgactcttcacggtcatccggtaatccaattttctgggaaactttttcgttttccgcaaatctcctttccgcctttagatgaagcgatatag

SEQ ID NO: 207 - protein, 379 aa, Chlamydia trachomatis
MKKTKYLRQVNLWVFVVIILLMSISVIVISSQDPSSMLVHTSRGLFSAKSKKQLDHFALGWCAYFICLYVDYHQFKRWAWVLYSLILFSLIGLFFVPAVQNVHRWYRIPIINLSVQPSEYAKLVVVIMLSYILEMRKARISSKTTAFVACIIVGIPFLLILKEPDLGTALVLCPIALTIFYLGNIYPPLVKVCSVLVALGMFCSLLIFSGIIPHDKVKPYALKVLKEYQYERLSPSNHHQRASLISIGVGGLKGQGWKSGEFAGRGWLPYGYTDSVFPAIGEEFGLLGLLFVLWLFYNLVCFGCRTVAVAVDDFGRFLAGGVTVNLVMHVLINVSMMSGLLPITGVPLVLISYGGSSVISTMASLGILQSIYSRRFAKY

SEQ ID NO: 208 - DNA, 1140 bp, Chlamydia trachomatis
atgaaaaaaacaaaatacttgcgtcaagtgaacttgtgggtctttgtagtcatcattctacttatgagcataagtgtgattgtgatctcttctcaagatccctcttctatgttagtccacacttcacgagggctgttctctgccaaaagcaaaaaacagttggatcactttgctctaggatggtgtgcctacttcatttgcttgtatgtagactaccatcaattcaaaagatgggcttgggttctctattctttgattcttttcagtcttattggactatttttcgtgcccgctgtacaaaatgtacaccgctggtaccgcatacccattattaatcttagcgtccaaccttcggaatatgccaaacttgtcgttgtcattatgctaagctatattctagagatgcgcaaagcacggatttcttctaaaacgacagcattcgttgcatgtattattgtggggattccttttctgcttatcttgaaagaaccggatctgggaacagccttggtgctatgcccaatagcccttaccattttttatctcggaaatatctatcctccactagtcaaagtctgttctgtgcttgtcgctttgggcatgttctgctctctactaatcttctctgggattatccctcatgacaaggtaaaaccttacgctcttaaagtattaaaagaatatcagtacgaacggctcagcccttccaaccatcaccaaagagcctctcttatttccattggagtaggagggctaaaaggccaaggatggaaatctggcgaattcgcagggaggggctggcttccttacggatatacagactctgtgttccctgctataggagaagaattcggactattaggactcttattcgtattatggttgttttacaacttagtctgtttcggctgccgtactgtggctgtcgcggttgatgattttggacgatttttagctggaggagtgaccgtaaacctggtcatgcacgtacttatcaatgtcagcatgatgagtggtctcctgcctattaccggagtccccttggtgttaatttcttatggaggttcttctgtaatttctactatggcttctttaggtattttacaaagcatctacagtcgacgctttgcaaaatactaa

SEQ ID NO: 209 - protein, 221 aa, Chlamydia trachomatis
MKKFIYKYSFGALLLLSGLSGLSSCCANSYGSTLAKNTAEIKEESVTLREKPDAGCKKKSSCYLRKFFSRKKPKEKTEPVLPNFKSYADPMTDSERKDLSFVVSAAADKSSIALAMAQGEIKGALSRLREIHPLALLQALAEDPALIAGMKKMQGRDWVWNIFITELSKVFSQAASLGAFSVADVAAFASTLGLDSGTVTSIVDGERWAELIDVVIQNPAI

SEQ ID NO: 210 - DNA, 666 bp, Chlamydia trachomatis
atgaaaaagtttatctataagtatagctttggagctctcttgttgctctccgggctctccggattgagcagctgttgcgccaactcttatggatcgactcttgcaaaaaatacagccgagataaaagaagaatctgttacacttcgcgagaagccggatgccggctgtaaaaagaaatcttcttgttacttgagaaaatttttctcgcgcaagaaacctaaagagaagacagagcctgtgttgccgaactttaagtcttacgcagatccaatgacagattccgaaagaaaagacctttctttcgtagtatctgctgctgctgataagtcttctattgctttggctatggctcagggggaaattaaaggcgcattatcgcgtattagagagatccatcctcttgcattgttacaagctcttgcagaagatcctgctttaattgctggaatgaaaaagatgcaaggacgggattgggtctggaatatctttatcacagaattaagcaaagttttttctcaagcagcatctttaggggctttcagcgttgcagacgttgccgcgttcgcgtcgaccttaggattagactcggggaccgttacctcaattgttgatggggaaaggtgggctgagctgatcgatgtcgtgattcagaaccctgctatataa

SEQ ID NO: 211 - protein, 821 aa, Chlamydia trachomatis
MNIYRFISGSCSWFLIGWGICFGADVPLSFGHQCADVRKAMQEGKPLLPIFDAFIRRIVNDSSSLSEKDWETATWLICEYIRGSLKRGEQELCSELVKPLFSLAVMPPQSKARIKQVWQVLNPQGASLKDLVRLLESSGCSSSPQDHLLLSLYNMTLHSSYENKKAEILFAREQKNYQDALRLCEELQENLTSGLCSPLSTVYEVEQAFLKRISLAIRWEQEKELQGSPSIELLLAYCSAEESYAEAVEQLIKKIELGSLDRSQEVDAILFAHALSKLPWEETLGEHELEVLISGGHYLTSIYSQHAYFSLLEQYFKKSQIQEISRLLDFGKTVFVETHKKYPEYLFFLGKYWFYLRDFSRAEEAFSSVIRYADRLGVSLAETYEYLGCLACYKGHYASAKEFFLKAYKGWGREDAGIGLYLLAVLEKDPILCQQVREQVSLSFSHQEFLKWMDRNFLPEPGKEGSSFFKVLGSSRSLSEEEFHGLLLKEMISRHHREKLSCSPIQRLVYDQLDREIQLRLTETLIQTEDLLVRRKLSLWRALYEGSLVSWGSAHQNQTLFEKSILQCFSALSQQDPSAIQQLAEAFSSGASLWQSSLRMVWAVSHTSENPISKAYSLGISDRPWGDRLYLLQYSLEQYLSGDTELLEYLTQFPELFPNSPLLPLVYYLQARGEGDPIRKIAWLTKALETFTENSLLAKEMKAWAPLYYLMRMDLAETYLYLGNVSKSQTLFEAIQEEWDAPHHPYVKLIDPPHIRVSLEMRWVSGLAHVYEAIQATEQRNALLISHIEKRFFQMRPRQEYIGKMLTFTSSLCRELLADAS

SEQ ID NO: 212 - DNA, 2466 bp, Chlamydia trachomatis
atgaatatttatagattcatctctggaagctgttcatggtttctgataggttgggggatatgcttcggagctgacgtgccactttcttttgggcaccaatgcgcagacgttcgcaaggcgatgcaagagggcaagccgcttttgcctatttttgatgcgtttattcgtcgtatcgtgaatgacagctcatctttatctgagaaagattgggaaacagcaacatggttaatttgtgaatatatacgagggagtttaaagcggggagaacaagagttatgctcggagcttgtaaaacctctgttttctttagctgtaatgcctccgcagtcaaaagctcgtattaagcaagtgtggcaggtactcaatcctcaaggagcttctttaaaggacttagtccgtttactggaaagtagcggatgctcctcttcaccgcaagatcatctcctactttctttatataatatgacactgcatagcagttatgagaacaagaaagcagagatcctttttgcaagagaacaaaaaaattatcaggacgctttacgtttatgcgaggagttgcaagaaaatctgacttcagggctttgttcacctctttcaacggtatatgaggtggagcaagccttcttaaagcgaatctccttagccatacggtgggaacaagagaaggagctgcaagggagcccctctatagagttgctattggcctattgtagtgcggaagagagttacgcagaggctgtggagcagttaatcaaaaaaatagaattaggaagcttagaccgatcacaagaagtcgacgcaattttatttgcacatgcgttaagtaaacttccatgggaagagactcttggagaacacgaactggaggttctcatatcaggaggacactatctcacatcgatttattctcaacatgcttacttttcgcttctcgaacaatattttaaaaaatctcaaatacaagaaatatctcgcttattagattttgggaaaaccgtctttgttgagacccataagaaatatccggaatacctcttctttctaggcaagtactggttttacttgcgggatttctctcgtgcagaagaggctttttcttctgtaattcggtatgcagatcgactgggagtgtctttagcggaaacttatgagtatttagggtgtttagcttgttacaaagggcactatgcttccgctaaagaattctttcttaaagcttacaaggggtgggggagagaggatgccggtataggattgtatctattggcagtcttagaaaaagatcctattttatgtcagcaggtcagagaacaggtgtctttatccttttcacatcaggaatttttaaaatggatggatagaaatttcttacctgagccagggaaagaaggctcttctttttttaaggtattgggaagctcgcgttctttatctgaagaagagtttcatggattactgctaaaggagatgattagtcgtcatcatagagagaagctctcttgctctcctatacaacggctagtgtacgaccagttggatcgagagatacaacttcggttgacagaaacattaattcaaacagaagatcttctggtgagacgcaagctctctttatggagagctctatatgaaggatcgttggtatcttgggggtctgctcatcagaatcagactttatttgagaaaagtattttgcagtgtttttctgctctgtcgcagcaggaccctagcgcaatacagcaaatagcagaagctttttcttcaggagcctctttatggcaatcctctttgaggatggtgtgggcagttagtcatactagtgaaaatcctatatcgaaggcatattcgttaggcatatctgatcggccttggggagatcgactgtatcttttacagtattcattagagcaatatctttctggagatacagaattattagagtatttaacacaattcccagaattattcccgaactcgcctttgttgcctttggtttattatttgcaggcaagaggtgagggagatccaattcgaaagatcgcttggttaacaaaagctttagagacttttacggaaaattctttgttagcaaaggagatgaaagcttgggctcctttgtattatttaatgcgaatggatttagcagaaacctacctatatttagggaatgtgtctaaatcacaaactcttttcgaagcgatccaagaagagtgggatgctccgcaccatccttatgtaaagttgatagatccgccgcacatccgtgtgtctttggagatgcgttgggtttcggggcttgctcatgtgtatgaagctatacaagcaactgaacaaagaaatgcgttattaatcagccacattgaaaaacgtttctttcaaatgcgaccaagacaggaatatattgggaagatgttaacattcacgagttctctatgcagagaactattagcagatgcctcatga

SEQ ID NO: 213 - protein, 245 aa, Chlamydia trachomatis
MNRRNTMLVATAVNAVLLAVLFMTARHSEQEIEYSQKIAPIKILEPVPVVDKAPEKLEKKPEVIAKPSQVVRNPVVSKAELAAQFADKNPKTEKESSGGSKEISSTPVESTTPVAPEISVVNAKVVEKTPEKEEFSTVIVKKGDFLERIARSNHTTVSALMQLNDLSSTQLQIGQVLRVPKTNKTEKDLQVKTPNLEDYYVVKEGDSPWAIALSNGIRLDELLKLNGLDEQKARRLRPGDRLRIR

SEQ ID NO: 214 - DNA, 738 bp, Chlamydia trachomatis
atgaatcgtagaaacacgatgattgtagcaactgctgtgaatgcagtgctattggcagtgctgtttatgaccgcgcgccattcagagcaagaaatagagtattctcagaaaatagctcctattaaaatcttagagcccgttccggttgttgataaggctccagagaagttagagaaaaagcctgaggtgattgcgaagccttctcaggtcgttagaaatcctgtcgtttctaaagctgaacttgctgcgcaatttgcagacaaaaatcctaagacagagaaggaatctagcgggggctctaaagagatttcatctacccctgtagaatcgacgactcctgtcgctccagaaatttctgttgtgaacgctaaggtagtagagaaaactcctgaaaaagaggaattctctactgttattgttaagaaaggagactttttagaacgtatagctagatccaatcacactacagtttctgcattgatgcagttgaatgacttatcttcgacacagttacagataggacaagtgttacgagttcctaaaacgaataagacagagaaggatcttcaagtgaagactccaaatctggaagattactatgtagtcaaggaaggagatagtccttgggccattgcattgagtaatggtattcgtttggatgagctgttgaagttaaatggattagatgagcagaaagctcgtagattacgtccaggggatagattacgaattcgataa

SEQ ID NO: 215 - protein, 385 aa, Chlamydia trachomatis
MKWFLISCLLGIFSLGLIMVFDTSSAEVLDRALSCSTHKALIRQITYLGLGLGIASFVYILGWKDFLKMSPMLLIFVGITLVLVLIPGIGVCRNGAKRWLGVGQLTLQPSEFVKYLVPCVAIECLTTKPSIRSSFKRFVAFVALLFIPIMLIAIEPDNGSAAVISFSLIPVFIVTAVRLRYWLLPLLCILCIGGTFAYRLPYVQNRLQVYLHPELDIKGRGHQPYQAKLAAGSGRVFGKGPGKGLQKLTYLPEAQNDYIAAIYAEEFGFIGMLLLILLYMGFIYSGYVIAMRASLLSGAALAISITVIIGMQAFINLGVVSGLLPSKGVNLPFFSQGGSSLIANMCGMGLLLRICDEENQQNRIGSGGNRRAHYPCSSSKRDFYS

SEQ ID NO: 216 - DNA, 1158 bp, Chlamydia trachomatis
atgaaatggttcctgatttcctgtttattaggaattttttctctcgggctgatcatggtgtttgatacctcatcagcagaggttttggatcgagctttgtcgtgtagtacacacaaagctctgatccggcagattacttatcttggattgggacttggtatcgcttcatttgtgtacatcttaggatggaaggatttcttgaaaatgagccctatgttgctgattttcgtggggattactcttgttttggttcttattccaggtattggtgtttgtagaaatggagctaagcgttggctaggagtggggcagttaactttacagccttctgaatttgttaaatatttagttccatgtgttgctatcgaatgtttaacaacaaaaccttctattcgtagtagttttaaacgattcgtagctttcgttgctctgttgtttatccccattatgttgatagcgattgaacctgacaatggatctgcggccgtgatctcattttccttaattccagtttttatcgtaactgcagtgcgattacgctattggctgcttcctttgctatgtattctgtgtattggaggtacatttgcctatcggctcccttatgttcagaatcgtttgcaagtttacctacatcctgaattagatattaaaggaagaggccatcaaccttaccaagctaaaattgcagcaggctctggaagagtgtttggtaaaggtccaggaaaaggattacaaaaattaacttatcttccagaagctcagaatgattacattgctgctatttacgcagaagagtttggatttattgggatgctcctattgattcttctctacatgggatttatttatagcgggtatgtcattgcaatgcgagcctcccttttatctggagcggctcttgctatttcaatcactgtgattattgggatgcaagcttttattaacttgggtgttgtttctgggttattgcctagcaagggagtgaaccttccattttttagtcagggaggctcttctctaattgctaatatgtgtggcatgggattgctattaaggatatgtgatgaagaaaatcaacaaaatcgtattggcagtggggggaacaggagggcacattatccctgctctagcagcaagagagacttttattcatga

SEQ ID NO: 217 - protein, 352 aa, Chlamydia trachomatis
MKKINKIVLAVGGTGGHIIPALAARETFIHEDIEVLLLGKGLAHFLGDDSEVAYCDIPSGSPFSLRVNRMFSGAKQLYKGYVAALQKIRDFTPDLAIGFGSYHSLPAMLASIRSRIPLFLHEQNIVPGKVNKLFSRFAKGVGMSFAAAGEHFHCRAEEVFLPIRKLSEQIVFPGASPVICVVGGSQGAKILNDVVPKALARIRESYSNLYVHHIVGPKGDLQAVSQVYQDAGINHTVTAFDHNMLGVLQASDLVISRSGATMLNELLWVQVPAILIPYPGAYGHQEVNAKFFTHTVGGGTMILQKYLTEESLSKQVLLALDPATSENRRKAMLSAQQKKSFKSLYQFICESL

SEQ ID NO: 218 - DNA, 1059 bp, Chlamydia trachomatis
atgaagaaaatcaacaaaatcgtattggcagtggggggaacaggagggcacattatccctgctctagcagcaagagagacttttattcatgaagacatagaagtcttacttttagggaaaggattagctcattttttaggggatgattcagaggtcgcctattgtgatatcccttcaggatcgcctttttctttgcgtgtcaatcggatgttctctggggctaagcagttatataaaggttatgtcgcagctctacaaaagatcagagattttactcctgatttagcaataggatttgggagttaccattccttacctgctatgcttgcttctataagaagtaggattcctctttttctgcatgaacagaatattgttcctgggaaagtgaataagttattttcacgttttgctaaaggtgtagggatgtcttttgcagcagcaggggaacatttccattgccgagccgaagaagtctttctccctatcaggaaactgtctgagcagatcgttttccctggagcttctcctgtcatttgtgtggtaggaggatcccaaggagcaaaaattttaaatgatgttgttccaaaagccttggctcgtattcgagaaagttattcgaatttatatgttcatcatattgtagggcctaaaggagaccttcaagcggtttctcaagtttatcaagatgctggtatcaatcatacagttaccgcatttgatcacaatatgctcggcgtactacaggcaagcgatttagtgattagtagatctggagcaacgatgcttaatgagttgctttgggttcaggtgcctgccattcttattccttatccaggtgcttatggacatcaagaagtgaatgcaaaattcttcacgcatactgtaggtggagggactatgattttgcagaagtatttaacagaagaaagtttgagtaagcaggttttacttgctttagatcctgcaaccagtgaaaataggcgcaaggctatgctttccgcacaacagaagaagtctttcaaatcactgtatcagtttatttgtgaatctctatag

SEQ ID NO: 219 - protein, 802 aa, Chlamydia trachomatis
MMKSLFYHFIGIGGIGMSALAHVLLDRGYSVSGSDLSEGKVVEKLKNKGAEFFLGNQEEHIPEGAVVVYSSSISKKNPEFLSAKSRGNRVVHRAELLAELAQDQISIFVTGSHGKTTVSSLITAILQEAKKNPSFAIGGLNQEGINGGSGSEYFVAEADESDGSIRCYTPEFSVITNIDDEHLSNFEGDRELLLASLKDFALKTQQICWYNGDCPRLRSCLQGHTFGLDSSCDLHILSYYQEGWRLYFTAKYQDVVYADIEVQLVGMHNVLNAAAAMGIALSLGIDEGAIRNAFRGFSGVQRRLQRKNSSETFLFLEDYAHHPSEISCTLRAVRTAVGQRRLLAIQPHRFSRLRECIDSFPSAFKDADEVLLTEVYSAGEEAEDISYQKLAEAISQESIVKCTHIPFHELQRHLEQSIRVHDVCVSLGAGNIVNLGEKLRDFEPQKLHLGIICGGKSCEHEISVLSAKNIAKHLSKSFYDVSYFLITREGLWESVSSLETAEDSGKSVFDPEIAQRLEKVDVVLPILHGPYGEDGAMQGFLETIGKPYTGPAIAFSAIAMNKVFTKRFMSDLGIPVVPYLPLTLAGWKQEQDKWLAHIVEAFSFPIFVKSSHLGSSIGVFEVHNVIELRDAINEAFMRDNDVFVEENRLGCKEIEVSVLGDGSGAFVVAGLHERRGSGGFIDYQEKYGLSGKSSAQIVFDTDLSKEIQEQILEAADKIYRLLLGKGSCRIDFFVDEEGNFWLSEMNPIPGMTETSPFLTSFIRKGWSYEQIVHQLVIDGLQRFNQRQRLISTSFVDQAFAIQ

SEQ ID NO: 220 - DNA, 2412 bp, Chlamydia trachomatis
atgatgaaaagcttgttttaccactttattggtattggtgggattggaatgagtgctttagcacatgttctgctcgatcgaggatatagcgtatcgggaagtgatctttccgaggggaaagtggtagagaagctgaagaataaaggagcggaattctttttagggaatcaagaagaacatatccctgaaggcgctgtagttgtatacagttcaagtatttctaaaaaaaatcctgaatttttatcagctaaaagtagagggaaccgcgtagttcatcgagccgaattattagccgagcttgctcaagatcagatttctatttttgttacaggaagtcatggaaagacaacagtctcttctttaattacagccattttgcaggaagcgaagaaaaatccgtcctttgctataggaggtttgaatcaagaaggcatcaatggtggttcgggatcggaatattttgttgctgaagcagatgagagcgatgggtctattcggtgttatactccagagttttctgttattacgaatatagatgatgagcatctgtctaattttgaaggagatcgagagcttcttctggcttctttgaaagactttgcactcaagactcagcagatctgttggtataatggagattgtcctcgcttgcgttcatgcttgcaagggcatacttttggattggactcttcttgtgatctacatattctatcttattatcaagaaggatggagactgtactttacagcaaagtatcaagatgtagtgtatgcagatatagaagtgcaattggtcggcatgcataacgttttgaatgctgcagcagctatgggaatagctctgtcattgggtatagatgaaggtgctataagaaatgctttcagagggttttcaggagttcaaagacgattacaaagaaagaattcttctgagacctttctctttttagaagattatgcacaccatccttcagagatttcttgtacattacgtgctgttcgtactgctgttggacagagacgtattttagctatttaccagcctcatcgtttttctcgattaagagagtgtatagacagcttcccgtcagcatttaaagatgctgatgaagtcttgttaacagaagtgtacagtgcaggagaggaggcggaagatatttcgtatcagaagcttgctgaagctattagtcaagagtcgatagtaaagtgtacgcatattccgtttcatgagttgcagagacatttagagcagtccatccgtgtacacgatgtgtgtgtatctttaggtgctggtaatattgtgaatttgggagaaaagttaagagattttgagcctcaaaaactgcacttaggaattatttgtggagggaaatcatgcgaacacgagatttccgttctatctgcaaaaaatatagctaaacatctttcaaaatccttttatgatgtgagttattttttaattactcgagaaggattatgggagagcgtctcttcattagagactgctgaagactcagggaaatccgtttttgatccagaaatagctcagagactagaaaaagtagacgtagtgttgccgatactacatggtccctatggtgaagatggagctatgcaaggatttctagagactattggcaagccttatacaggtcctgctatcgctttttctgcgatagcaatgaataaagtgtttactaagcgttttatgagtgatttagggattcctgtcgttccttatctccctttaacattagcaggatggaagcaagaacaagataagtggttagcacatattgtagaggctttttcatttcctatatttgtgaaatcttcgcatttaggatctagtatcggcgtcttcgaagttcataatgttatagaattacgagatgccattaatgaagcttttatgcgagataacgacgtgtttgtagaagaaaatcgcttaggttgcaaagaaatagaagtttctgtcttaggagatggatctggtgcgtttgtcgttgctggtctgcatgagcgtcgtgggagtggaggttttatagactatcaagagaagtatgggttaagtggtaagtctagtgcgcagatcgtatttgatacagatctctctaaagaaatacaggaacaaatactagaagctgcggataaaatttaccgtttattgctagggaaagggtcgtgtcgtattgacttttttgtagatgaagaaggaaatttctggttatctgagatgaaccccattcctggaatgacagaaacgagcccatttcttacatctttcattcgtaaagggtggagttatgaacagatagtccatcaacttgttattgatgggctgcaacgatttaaccaacgccaacgcttgatatcgacgtcttttgtagatcaagcgttcgctattcagtaa

SEQ ID NO: 221 - protein, 164 aa, Chlamydia trachomatis
MRNWLLGSLLIACMAVTAPCFAAKRRAAGSQKINRVAETGIHWMSYQDALNKAKQEGKHVAVFFTGSDWCIWCMRMQDQILQTAAFSEFAKQYLCMVEIDFPHNKEQTAEQKEQNRHLKSLYSVDGFPTLVLLDSEGKEVAKMGFEPGGGEAYVYRLKKALHIS

SEQ ID NO: 222 - DNA, 495 bp, Chlamydia trachomatis
atgagaaactggttattagggagcttgctcatcgcatgtatggcggtcacagctccttgttttgctgcaaaacgtcgtgctgcgggttcgcagaagatcaatagggttgcagagaccggaattcactggatgtcttatcaagatgctttgaataaggcaaaacaggaaggaaagcatgtagccgtatttttcacaggatccgattggtgtatttggtgtatgagaatgcaggatcagattttacaaacagctgcattttccgagtttgctaaacaatatttgtgtatggtggagatagatttccctcacaacaaagaacaaactgcagaacaaaaagagcagaatcgtcatttgaaaagtttatattctgtagacggattccccaccctagttttactcgattccgaaggtaaagaagtcgcaaaaatgggatttgagcctggaggcggagaggcatatgtttatagattaaagaaagcattacatatctcctga

SEQ ID NO: 223 - protein, 166 aa, Chlamydia trachomatis
MNSGMFPFTFFLLYICLGMLTAYLANKKNRNLIGWFLAGMFFGIFAIIFLLILPPLPSSTQDNRSMDQQDSEEFLLQNTLEDSEIISIPDTMNQIAIDTEKWFYLNKDYTNVGPISIVQLTAFLKECKHSPEKGIDPQELWVWKKGMPNWEKVKNIPELSGTVKDE

SEQ ID NO: 224 - DNA, 501 bp, Chlamydia trachomatis
atgaactccggaatgttcccattcaccttttttttactgtacatctgtctgggaatgcttacggcgtacctagctaataaaaaaaatcgcaatctaataggctggtttttggcaggaatgttttttggtatttttgccattatcttcctattaattctccctcctcttccttcttctacacaagataatcgttccatggaccagcaagattccgaagaattccttttacagaatactttagaggactcagaaattatttccatcccagatacaatgaatcaaattgcgattgatacagaaaagtggttctacttaaataaagactatactaatgtcggtcctatttccatcgtacagctgaccgcattcttaaaagaatgcaaacactctcctgaaaaagggatcgatccccaagaattatgggtatggaagaaaggaatgcctaactgggaaaaggtgaagaatataccggaactttcaggaacagtaaaagacgagtaa

SEQ ID NO: 225 - protein, 956 aa, Chlamydia trachomatis
MDNHPPVINDPTNDPKNMKRSLSLLLLCIPSFLTACSKSFQTIRDENPLTILTPALADQKIAKILCPNGLSLMIVSSPHAAESGAALVVKTGNNADPVEFPGLAHFTEHCVFLGNEKYPEPSGFPAFLSTHGGIYNAFTYPDKTCFLFSVNNADLDNALDQFVHLFIQPLFRQEDLNKEVHAVEQEFAMHPTKDSRRMHRIQQLIAPKNHPLKRFGCGNLSTLNSVTTQDMQTWFATHYSPENMAAIVYTTAPLDTAVPYIASLFSEIPISAQYTPQKPFPKTQDTTALNKLFINKAVEPSPQLAIYWHFYDAPQSLQGWAQSLISILSSEKENSLVALLKKEQLITEMEAELYSTSHNTQDFEILYKLTNKGEREYQRVLQLTFAFLDYVRHERLPAYSLPEIQKINSLEYTYSTQTELFSTLSRMVPNFTSEPLATYPYRSLVYPEYSQEDEQTFATFLADPQQARYILSATLPSSWENADEFYDPIFDDTFYEKPLDFTPIQDSSSLGFAFPNPNKFIPQTVQLLSQKKQHEGFAFSPQLTYDQNAITLYTCEDSFYTIPKMAMELRIRSPQIQRTDVRSLVLRDLYSLLANETLIKRYDDALKAGMTFAVSPGATGVDLSLLGYTETSPVLLNALLSSLRDLPVEESLFLYYKDQLSEQYQKNLIACPLRAGLNKLYSQILVDTVSLEDKLNTLNTLSYEEFANFTNKLLQELAVESLALGTLSAQDLSNLLSTLSNFAEASSPYAAPSYYPQRKPLSSTKLSFQYPLSGNGMLLLEQNEDPHQYKDSVATSMLLSWIHNLYFSDLRTEQQLGYMVGSKYLEFAETPCGLFYIRSNNYSPEELVHRTQLFIQKIATDPESAGLSEEIFEQLRETYIQSILLPSSTPLAMAKKLFSIAFETKKQDFSRPDQKLAAARSMDYSYFKKYCEEFLSQKFGPEIQLLVYGANSSQEK

SEQ ID NO: 226 - DNA, 2871 bp, Chlamydia trachomatis
atggacaaccaccctcctgttatcaatgaccctaccaatgaccccaaaaatatgaagcgttccctatccctattacttctttgcattccttcttttctaactgcttgctcgaaatcctttcaaacgattcgagatgaaaatcctttgactattttgacccctgcattagcagatcaaaaaattgctaaaattctatgccctaacggactctctctcatgattgtatcctcccctcatgctgctgagtccggagccgctttagttgtcaaaacaggaaataatgcagatcctgtcgagttcccaggcttagcccattttacagaacactgtgtgttcctcgggaatgaaaaatatcccgagccctcaggatttcctgccttcctaagcacacatgggggtatctataacgcatttacttacccagataaaacctgcttcctattctccgtaaacaatgcagatttagataatgctctggatcagtttgtacatctctttatccaacctctcttccgccaagaagatttaaacaaagaagttcatgctgttgagcaagaatttgcgatgcatccaactaaagattctcgtcgtatgcatcgtattcaacaacttatagctcctaaaaatcacccattaaaacgctttggctgcggcaatctctctaccctcaactccgtcactactcaagatatgcaaacatggtttgccactcactactctccagaaaatatggcagcaattgtttacactacagctccgttggacaccgcagtgccgtatatcgcgtccctattctctgaaatccctatatctgcacagtacacaccacaaaaaccgtttccaaagacacaggatactactgctcttaataaactgttcatcaataaggctgtcgaaccttctccacaactagctatttactggcatttttatgatgctccacagtccttacaaggatgggctcagtcactgatttctattttatctagtgaaaaagaaaatagtcttgttgctttactcaaaaaagaacagctcattactgagatggaagcagaactttacagcacttctcataatacacaagattttgaaattctttataaactcaccaataagggggaacgcgaatatcaaagagttttgcagctaacttttgcttttcttgattatgttcgtcatgaacgacttcctgcctactccttgccagagatacagaaaatcaactctttagaatatacttacagcacgcaaaccgagttattctcgacactatcacgaatggtccccaattttacttctgaaccattagcaacatacccttatcgctctcttgtctatccagaatactcccaagaagatgaacaaacctttgctacatttttagcagaccctcaacaggcacgttatatcttatctgctaccctaccgagttcttgggagaatgcagatgaattctatgatcccatctttgacgacactttctatgaaaaacccttagatttcacacctatacaggactcctcctccttaggatttgcttttccgaatcccaataaatttattcctcaaacagtccaattattatctcaaaagaaacaacacgaagggtttgctttttctccgcagctgacctatgatcaaaatgcgatcactttatatacttgtgaagactctttctatacgattcctaaaatggctatggagttgcgcatccgttctcctcaaattcaacgaacagatgtgcgttctttagtattacgagacctatatagtctactagctaatgaaacattaataaaacgttatgacgatgctttaaaagctggaatgacttttgcagtatctcctggagcgacaggggttgatctttctcttttaggatatactgagacctctcctgttcttatcaatgctttgctgtcttctttacgagatcttcctgtggaagaaagtctgtttctatattacaaagatcagctatcagaacaatatcagaagaatcttattgcctgccctataagagctggtctcaataaactatactctcagattcttgttgataccgtttccttagaagataagctcaatactttaaacaccctctcctacgaagagtttgcgaacttcacgaataaactactccaagaactagctgtagaatctttagcactaggaacgctctcggctcaagatctctccaatttattatcgactctctctaactttgcagaagcttcgtctccttatgctgctcctagctattatcctcaaagaaaacctctctcttctacaaagctttcgttccaatatcctctctctggaaatggtatgctgctgctcgaacaaaacgaagatccccatcaatataaggactctgtagctactagtatgttgttatcttggatccataacttgtacttctctgatttacgtacagagcaacaacttgggtatatggtaggttctaaatatctggaattcgcagaaactccttgtggacttttctatattcgatccaataactattctcctgaggagcttgtgcatagaacacaactctttatacaaaagattgctactgatccagaatctgcaggcttgtccgaagagatctttgaacagcttcgagaaacatatatccagtccatattgcttccaagttccacacctttagctatggcgaaaaaattattctctatagcttttgaaacgaaaaaacaggatttttctcgcccagaccaaaaaatagctgctgcccgttctatggattacagctatttcaaaaagtactgtgaagaatttttgagtcaaaagtttggcccagaaatccaactcctcgtctatggagccaactcgtctcaggaaaaataa

SEQ ID NO: 227 - protein, 1531 aa, Chlamydia trachomatis
MSSEKDIKSTCSKFSLSVVAAILASVSGLASCVDLHAGGQSVNELVYVGPQAVLLLDQIRDLFVGSKDSQAEGQYRLIVGDPSSFQEKDADTLPGKVEQSTLFSVTNPVVFQGVDQQDQVSSQGLICSFTSSNLDSPRDGESFLGIAFVGDSSKAGITLTDVKASLSGAALYSTEDLLFEKIKGGLEFASCSSLEQGGACAAQSILIHDCQGLQVKHCTTAVNAEGSSANDHLGFGGGAFFVTGSLSGEKSLYMPAGDMVVANCDGAISFEGNSANFANGGALAASGKVLFVANDKKTSFIENRALSGGALAASSDIAFQNCAELVFKGNCAIGTEDKGSLGGGAISSLGTVLLQGNHGITCDKNESASQGGAIFGKNCQISDNEGPVVFRDSTACLGGGALAAQEIVSIQNNQAGISFEGGKASFGGGIACGSFSSAGGASVLGTIDISKNLGAISFSRTLCTTSDLGQMEYQGGGALFGENISLSENAGVLTFKDNIVKTFASNGKILGGGALLATGKVEITNNSEGISFTGNARAPQALPTQEEFPLFSKKEGRPLSSGYSGGGAILGREVAILHNAAVVFEQNRLQCSEEEATLLGCCGGGAVHGMDSTSIVGNSSVRFGNNYAMGQGVSGGALLSKTVQLAGNGSVDFSRNIASLGGGALQASEGNCELVDNGYVLFRDNRGRVYGGAISCLRGDVVISGNKGRVEFKDNIATRLYVEETVEKVEEVEPAPEQKDNNELSFLGRAEQSFITAANQALFASEDGDLSPESSISSEELAKRRECAGGAIFAKRVRIVDNQEAVVFSNNFSDIYGGAIFTGSLREEDKLDGQIPEVLISGNAGDVVFSGNSSKRDEHLPHTGGGAICTQNLTISQNTGNVLFYNNVACSGGAVRIEDHGNVLLEAFGGDIVFKGNSSFRAQGSDAIYFAGKESHITALNATEGHAIVFHDALVFENLEERKSAEVLLINSRENPGYTGSIRFLEAESKVPQCIHVQQGSLELLNGATLCSYGFKQDAGAKLVLAAGAKLKILDSGTPVQQGHAISKPEAEIESSSEPEGAHSLWIAKNAQTTVPMVDIHTISVDLASFSSSQQEGTVEAPQVIVPGGSYVRSGELNLELVNTTGTGYENHALLKNEAKVPLMSFVASGDEASAEISNLSVSDLQIHVVTPEIEEDTYGHMGDWSEAKIQDGTLVISWNPTGYRLDPQKAGALVFNALWEEGAVLSALKNARFAHNLTAQRMEFDYSTNVWGFAFGGFRTLSAENLVAIDGYKGAYGGASAGVDIQLMEDFVLGVSGAAFLGKMDSQKFDAEVSRKGVVGSVYTGFLAGSWFFKGQYSLGETQNDMKTRYGVLGESSASWTSRGVLADALVEYRSLVGPVRPTFYALHFNPYVEVSYASMKFPGFTEQGREARSFEDASLTNITIPLGMKFELAFIKGQFSEVNSLGISYAWEAYRKVEGGAVQLLEAGFDWEGAPMDLPRQELRVALENNTEWSSYFSTVLGLTAFCGGFTSTDSKLGYEANTGLRLIF

SEQ ID NO: 228 - DNA, 4596 bp, Chlamydia trachomatis
atgagttccgagaaagatataaaaagcacctgttctaagttttctttgtctgtagtagcagctatccttgcctctgttagcgggttagctagttgcgtagatcttcatgctggaggacagtctgtaaatgagctggtatatgtaggccctcaagcggttttattgttagaccaaattcgagatctattcgttgggtctaaagatagtcaggctgaaggacagtataggttaattgtaggagatccaagttctttccaagagaaagatgcggatactcttcccgggaaggtagagcaaagtactttgttctcagtaaccaatcccgtggttttccaaggtgtggaccaacaggatcaagtctcttcccaagggttaatttgtagttttacgagcagcaaccttgattctcctcgtgacggagaatcttttttaggtattgcttttgttggggatagtagtaaggctggaatcacattaactgacgtgaaagcttctttgtctggagcggctttatattctacagaagatcttatctttgaaaagattaagggtggattggaatttgcatcatgttcttctctagaacaggggggagcttgtgcagctcaaagtattttgattcatgattgtcaaggattgcaggttaaacactgtactacagccgtgaatgctgaggggtctagtgcgaatgatcatcttggatttggaggaggcgctttctttgttacgggttctctttctggagagaaaagtctctatatgcctgcaggagatatggtagttgcgaattgtgatggggctatatcttttgaaggaaacagcgcgaactttgctaatggaggagcgattgctgcctctgggaaagtgctttttgtcgctaatgataaaaagacttcttttatagagaaccgagctttgtctggaggagcgattgcagcctcttctgatattgcctttcaaaactgcgcagaactagttttcaaaggcaattgtgcaattggaacagaggataaaggttctttaggtggaggggctatatcttctctaggcaccgttcttttgcaagggaatcacgggataacttgtgataagaatgagtctgcttcgcaaggaggcgccatttttggcaaaaattgtcagatttctgacaacgaggggccagtggttttcagagatagtacagcttgcttaggaggaggcgctattgcagctcaagaaattgtttctattcagaacaatcaggctgggatttccttcgagggaggtaaggctagtttcggaggaggtattgcgtgtggatctttttcttccgcaggtggtgcttctgttttagggaccattgatatttcgaagaatttaggcgcgatttcgttctctcgtactttatgtacgacctcagatttaggacaaatggagtaccagggaggaggagctctatttggtgaaaatatttctctttctgagaatgctggtgtgctcacctttaaagacaacattgtgaagacttttgcttcgaatgggaaaattctgggaggaggagcgattttagctactggtaaggtggaaattactaataattccgaaggaatttcttttacaggaaatgcgagagctccacaagctcttccaactcaagaggagtttcctttattcagcaaaaaagaagggcgaccactctcttcaggatattctgggggaggagcgattttaggaagagaagtagctattctccacaacgctgcagtagtatttgagcaaaatcgtttgcagtgcagcgaagaagaagcgacattattaggttgttgtggaggaggcgctgttcatgggatggatagcacttcgattgttggcaactcttcagtaagatttggtaataattacgcaatgggacaaggagtctcaggaggagctcttttatctaaaacagtgcagttagctgggaatggaagcgtcgatttttctcgaaatattgctagtttgggaggaggagctcttcaagcttctgaaggaaattgtgagctagttgataacggctatgtgctattcagagataatcgagggagggtttatgggggtgctatttcttgcttacgtggagatgtagtcatttctggaaacaagggtagagttgaatttaaagacaacatagcaacacgtctttatgtggaagaaactgtagaaaaggttgaagaggtagagccagctcctgagcaaaaagacaataatgagctttctttcttagggagagcagaacagagttttattactgcagctaatcaagctcttttcgcatctgaagatggggatttatcacctgagtcatccatttcttctgaagaacttgcgaaaagaagagagtgtgctggaggagctatttttgcaaaacgggttcgtattgtagataaccaagaggccgttgtattctcgaataacttctctgatatttatggcggcgccatttttacaggttctcttcgagaagaggataagttagatgggcaaatccctgaagtcttgatctcaggcaatgcaggggatgttgttttttccggaaattcctcgaagcgtgatgagcatcttcctcatacaggtgggggagccatttgtactcaaaatttgacgatttctcagaatacagggaatgttctgttttataacaacgtggcctgttcgggaggagctgttcgtatagaggatcatggtaatgttcttttagaagcttttggaggagatattgtttttaaaggaaattcttctttcagagcacaaggatccgatgctatctattttgcaggtaaagaatcgcatattacagccctgaatgctacggaaggacatgctattgttttccacgacgcattagtttttgaaaatctagaagaaaggaaatctgctgaagtattgttaatcaatagtcgagaaaatccaggttacactggatctattcgatttttagaagcagaaagtaaagttcctcaatgtattcatgtacaacaaggaagccttgagttgctaaatggagccacattatgtagttatggttttaaacaagatgctggagctaagttggtattggctgctggagctaaactgaagattttagattcaggaactcctgtacaacaagggcatgctatcagtaaacctgaagcagaaatcgagtcatcttctgaaccagagggtgcacattctctttggattgcgaagaatgctcaaacaacagttcctatggttgatatccatactatttctgtagatttagcctccttctcttctagtcaacaggaggggacagtagaagctcctcaggttattgttcctggaggaagttatgttcgatctggagagcttaatttggagttagttaacacaacaggtactggttatgaaaatcatgctttattgaagaatgaggctaaagttccattgatgtctttcgttgcttctggtgatgaagcttcagccgaaatcagtaacttgtcggtttctgatttacagattcatgtagtaactccagagattgaagaagacacatacggccatatgggagattggtctgaggctaaaattcaagatggaactcttgtcattagttggaatcctactggatatcgattagatcctcaaaaagcaggggctttagtatttaatgcattatgggaagaaggggctgtcttgtctgctctgaaaaatgcacgctttgctcataatctcactgctcagcgtatggaattcgattattctacaaatgtgtggggattcgcctttggtggtttccgaactctatctgcagagaatctggttgctattgatggatacaaaggagcttatggtggtgcttctgctggagtcgatattcaattgatggaagattttgttctaggagttagtggagctgctttcctaggtaaaatggatagtcagaagtttgatgcggaggtttctcggaagggagttgttggttctgtatatacaggatttttagctggatcctggttcttcaaaggacaatatagccttggagaaacacagaacgatatgaaaacgcgttatggagtactaggagagtcgagtgcttcttggacatctcgaggagtactggcagatgctttagttgaataccgaagtttagttggtcctgtgagacctactttttatgctttgcatttcaatccttatgtcgaagtatcttatgcttctatgaaattccctggctttacagaacaaggaagagaagcgcgttcttttgaagacgcttcccttaccaatatcaccattcctttagggatgaagtttgaattggcgttcataaaaggacagttttcagaggtgaactctttgggaataagttatgcatgggaagcttatcgaaaagtagaaggaggcgcggtgcagcttttagaagctgggtttgattgggagggagctccaatggatcttcctagacaggagctgcgtgtcgctctggaaaataatacggaatggagttcttacttcagcacagtcttaggattaacagctttttgtggaggatttacttctacagatagtaaactaggatatgaggcgaatactggattgcgattgatcttttaa

SEQ ID NO: 229 - protein, 497 aa, Chlamydia trachomatis
MMKRLLCVLLSTSVFSSPMLGYSASKKDSKADICLAVSSGDQEVSQEDLLKEVSRGFSRVAAKATPGVVYIENFPKTGNQAIASPGNKRGFQENPFDYFNDEFFNRFFGLPSHREQQRPQQRDAVRGTGFIVSEDGYVVTNHHVVEDAGKIHVTLHDGQKYTAKIVGLDPKTDLAVIKIQAEKLPFLTFGNSDQLQIGDWAIAIGNPFGLQATVTVGVISAKGRNQLHIVDFEDFIQTDAAINPGNSGGPLLNINGQVIGVNTAIVSGSGGYIGIGFAIPSLMAKRVIDQLISDGQVTRGFLGVTLQPIDSELATCYKLEKVYGALVTDVVKGSPAEKAGLRQEDVIVAYNGKEVESLSALRNAISLMMPGTRVVLKIVREGKTIEIPVTVTQIPTEDGVSALQKMGVRVQNITPEICKKLGLAADTRGILVVAVEAGSPAASAGVAPGQLLLAVNRQRVASVEELNQVLKNSKGENVLLMVSQGDVVRFIVLKSDE

SEQ ID NO: 230 - DNA, 1494 bp, Chlamydia trachomatis
atgatgaaaagattattatgtgtgttgctatcgacatcagttttctcttcgccaatgctaggctatagtgcgtcaaagaaagattctaaggctgatatttgtcttgcagtatcctcaggagatcaagaggtttcacaagaagatctgctcaaagaagtatcccgaggattttctcgggtcgctgctaaggcaacgcctggagttgtatatatagaaaattttcctaaaacagggaaccaggctattgcttctccaggaaacaaaagaggctttcaagagaacccttttgattattttaatgacgaattttttaatcgattttttggattgccttcgcatagagagcagcagcgtccgcagcagcgtgatgctgtaagaggaactgggttcattgtttctgaagatggttatgttgttactaaccatcatgtagtcgaggatgcaggaaaaattcatgttactctccacgacggacaaaaatacacagctaagatcgtggggttagatccaaaaacagatcttgctgtgatcaaaattcaagcggagaaattaccatttttgacttttgggaattctgatcagctgcagataggtgactgggctattgctattggaaatccttttggattgcaagcaacggtcactgtcggggtcattagtgctaaaggaagaaatcagctacatattgtagatttcgaagactttattcaaacagatgctgccattaatcctgggaattcaggcggtccattgttaaacatcaatggtcaagttatcggggttaatactgccattgtcagtggtagcgggggatatattggaatagggtttgctattcctagcttgatggctaaacgagtcattgatcaattgattagtgatgggcaggtaacaagaggctttttgggagttaccttgcaaccgatagattctgaattggctacttgttacaaattggaaaaagtgtacggagctttggtgacggatgttgttaaaggttctccagcagaaaaagcagggctgcgccaagaagatgtcattgtggcttacaatggaaaagaagtagagtctttgagtgcgttgcgtaatgccatttccctaatgatgccagggactcgtgttgttttaaaaatcgttcgtgaagggaaaacaatcgagatacctgtgacggttacacagatcccaacagaggatggcgtttcagcgttgcagaagatgggagtccgtgttcagaacattactccagaaatttgtaagaaactcggattggcagcagatacccgagggattctggtagttgctgtggaggcaggctcgcctgcagcttctgcaggcgtcgctcctggacagcttatcttagcggtgaataggcagcgagtcgcttccgttgaagagttaaatcaggttttgaaaaactcgaaaggagagaatgttctccttatggtttctcaaggagatgtggtgcgattcatcgtcttgaaatcagacgagtag

SEQ ID NO: 231 - protein, 589 aa, Chlamydia trachomatis
MKKFISYLLIILPLIGLWEFCAQNYPSFGFICPPPSKVLTTGIHSFPVLFQHSCYTAQGILGGFFLALLLAILFSATMLLFPSTQGLLHPLCVLVQCLPMFTLAPLIVLWFGWGTRAVIIPTALSIFFPLALTIHQGIKNSPEELLEQFTLYQATTWQKLFKLRIPNGLPHIFSGLKIAMSAAGFATIAGEWVATQSGLGILILESRRNYDMAMALAGLFVLTMLTLSLFYSVLLLERSTFFFFRMEKTSKRSFGKKWVFALIPITVLPCLFYLKDDPKLAAPVPTKSFTLLLDWTPNPNHIPLYAGVEKGFFVDEGISLTLQKNTDTCSSIPHLLLEKVDYTLYHSLGVLKTAVRGAPVQVAGRLIDSSLQGLIYRKNEGIEKLEDLNGRVLGFCLNDSKNLPNLLEALRKHHVVPSEIKNVSADMISPMLTYQIDFLYGGFYNVEGVTIALKGTPTGCFLSDTYGSPTGPQLLICGKKGSPAMTPQTLQSLQKALSRSLDFCREYPQEAFAIYVEATKDSPKVLSDERAQWEVTLPLLAKTQEPLSRELLESLLVTLSTTCPDLRTSIDTFSIETLISDVSETIASS

SEQ ID NO: 232 - DNA, 1770 bp, Chlamydia trachomatis
atgaaaaaatttattagctatttactcatcatccttcccttgattggactctgggagttttgtgctcaaaactatccgagttttggctttatatgccctcctccatcgaaggtacttacgacagggatccattctttcccggtactattccagcattcttgctatacagcccaaggcattttaggaggattctttttagcattactacttgctatcctcttttctgctaccatgcttctatttccttctactcaaggcttgttgcaccccttgtgtgttctggtgcaatgccttcctatgttcactctagcccctttaatcgttctttggtttggttgggggacaagggcagtaatcatcccaacagctcttagcatctttttccctttagctctgaccattcatcagggaattaaaaattctcctgaggaactcttagaacaatttacgctttaccaagcaactacttggcagaaactctttaaattaagaattcctaacggtctgccacatattttctctgggcttaaaattgctatgagtgccgcaggatttgcgaccattgctggagaatgggttgcaacacaatctggtctaggtattcttattctggaaagccgcagaaactatgacatggcaatggctctagcgggtttatttgtcctaaccatgctgactctaagtctgttttatagcgttttacttcttgagcgcagcaccttttttttctttagaatggaaaaaacttccaaaagatcttttgggaaaaaatgggtctttgctctaattccaattactgtattgccctgtcttttctacttaaaagacgatccaaaattagccgctcccgtccctactaaatcctttactctactcttggattggactccgaatcctaatcacattcccctctatgcaggtgtagaaaaaggattttttgtagatgaagggatttccttaaccttacaaaaaaatacggatacttgttcttctattcctcatctgcttcttgagaaagtagattacacgctttaccacagcttaggggtattgaaaactgcagttcgaggagctcctgttcaagtagcaggcagacttatcgacagctccttgcaaggtctgatctatagaaaaaatgaaggcattgaaaaacttgaagatcttaacggacgcgtactaggcttttgcctcaatgactccaagaacctgcctaatctgctagaggctttacgcaagcatcatgtggttccttcagaaatcaaaaacgtcagcgcagatatgatttctcctatgctcacttatcaaattgatttcttgtatggaggtttttacaatgttgagggcgtcactatcgccttaaagggaacccctaccggttgttttctttctgacacttatggatcccctacaggcccgcagctccttatttgcgggaaaaaagggtctccagcgatgacacctcaaacactccaaagcttgcaaaaagctttatctcgcagtctggatttctgtcgtgaatatccccaagaggctttcgctatctacgtagaagcaactaaagactctcctaaagtgttatccgatgagcgggctcaatgggaagttacccttcctttgttggccaaaactcaggaacctttatcacgagaattgctagaatctctactcgtaacattgtctacaacttgccctgatctgcgaacttccatcgatactttttctattgaaaccttgattagtgatgtatctgagacaatagcttcttcctaa

SEQ ID NO: 233 - protein, 601 aa, Chlamydia trachomatis
MKMNRIWLLLLTFSSAIHSPVQGESLVCKNALQDLSFLEHLLQVKYAPKTWKEQYLGWDLVQSSVSAQQKLRTQENPSTSFCQQVLADFIGGLNDFHAGVTFFAIESAYLPYTVQKSSDGRFYFVDIMTFSSEIRVGDELLEVDGAPVQDVLATLYGSNHKGTAAEESAALRTLFSRMASLGHKVPSGRTTLKIRRPFGTTREVRVKWRYVPEGVGDLATIAPSLRAPQLQKSMRSFFPKKDDAFHRSSSLFYSPMVPHFWAELRNHYATSGLKSGYNIGSTDGFLPVIGPVLWESEGLFRAYISSVTDGDGKSHKVGFLRIPTYSWQDMEDFDPSGPPPWEEFAKIIQVFSSNTEALIIDQTNNPGGSVLYLYALLSMLTDRPLELPKHRMILTQDEVVDALDWLTLLENVDTNVESRLALGDNMEGYTVDLQVAEYLKSFGRQVLNCWSKGDIELSTPIPLFGFEKIHPHPRVQYSKPICVLINEQDFSCADFFPVVLKDNDRALIVGTRTAGAGGFVFNVQFPNRTGIKTCSLTGSLAVREHGAFIENIGVEPHIDLPFTANDIRYKGYSEYLDKVKKLVCQLINNDGTLLLAEDGSF

SEQ ID NO: 234 - DNA, 1806 bp, Chlamydia trachomatis
atgaaaatgaataggatttggctattactgcttaccttttcttctgccatacattctcctgtacaaggagaaagcttggtttgcaagaatgctcttcaagatttgagttttttagagcatttattacaggttaaatatgctcctaaaacatggaaagagcaatacttaggatgggatcttgttcaaagctccgtttctgcacagcagaagcttcgtacacaagaaaatccatcaacaagtttttgccagcaggtccttgctgattttatcggaggattaaatgactttcacgctggagtaactttctttgcgatagaaagtgcttaccttccttataccgtacaaaaaagtagtgacggccgtttctactttgtagatatcatgactttttcttcagagatccgtgttggagatgagttgctagaggtggatggggcgcctgtccaagatgtactcgctactctatatggaagcaatcacaaagggactgcagctgaagagtcggctgctttaagaacactattttctcgcatggcctctttagggcacaaagtaccttctgggcgcactactttaaagattcgtcgtccttttggtactacgagagaagttcgtgtgaaatggcgttatgttcctgaaggtgtaggagatttggctaccatagctccttctatcagggctccacagttacagaaatcgatgagaagctttttccctaagaaagatgatgcgtttcatcggtctagttcgctattctactctccaatggttccgcatttttgggcagagcttcgcaatcattatgcaacgagtggtttgaaaagcgggtacaatattgggagtaccgatgggtttctccctgtcattgggcctgttatatgggagtcggagggtcttttccgcgcttatatttcttcggtgactgatggggatggtaagagccataaagtaggatttctaagaattcctacatatagttggcaggacatggaagattttgatccttcaggaccgcctccttgggaagaatttgctaagattattcaagtattttcttctaatacagaagctttgattatcgaccaaacgaacaacccaggtggtagtgtcctttatctttatgcactgctttccatgttgacagaccgtcctttagaacttcctaaacatagaatgattctgactcaggatgaagtggttgatgctttagattggttaaccctgttggaaaacgtagacacaaacgtggagtctcgccttgctctgggagacaacatggaaggatatactgtggatctacaggttgccgagtatttaaaaagctttggacgtcaagtattgaattgttggagtaaaggggatatcgagttatcaacgcctattcctctttttggttttgagaagattcatccacatcctcgagttcaatactctaaaccgatttgtgttttgatcaatgagcaagacttttcttgtgctgacttcttccctgtagttttgaaagacaatgatcgagctcttattgttggtactcgaacagctggagctggaggatttgtctttaatgtgcagttcccaaatagaactggaataaaaacttgttctttaacaggatcattagctgttagagagcatggtgccttcattgagaacatcggagtcgaaccgcatatcgatctgccttttacagcgaatgatattcgctataaaggctattccgagtatcttgataaggtcaaaaaattggtttgtcagctgatcaataacgacggtaccattattcttgcggaagatggtagtttttaa

SEQ ID NO: 235 - protein, 482 aa, Chlamydia trachomatis
MDTPTPLSSVPTNASLKGEPGSSSQFSSAEKGVLKTSVGDVVLSQSIEDGGNETQISLVGVVNINMAQEELPTLVSPRTFIFLPPETVELEIQLAEMFQALEETPSSDSRSLQQKETSAQTPPAPSGKVSIFSLQAQGSSQTRSLPSSQESLSPQQPARAIQGLNTPFSPAARCTLRAVPLSIVPHRRANPTSSQSVSHHSSRTYQTGHSTGTAQLSSQEWEFSSQTVKTCSTGREKRDGQQERHSDQEQNSDHSYQEEDLSDDMQVSSSKRSSHPEDENTEEVFSVSHFAYHAAPHPSSNLDQESNQSTFQKRPPSPMSLFSSQNATEEAPKEARVENVFLRFMRLMARILGQAEAEAHELYLRVKERTDNVDALTLLLSKINNEKGAIDWNQDEEMRALVDQAKKLGVPIGDSYDWSEEGKKLLKENIQMRKENMEKITQLERTDMQRHLQEVSQCHQARSNVLKLLKELMDTFIYNMRP

SEQ ID NO: 236 - DNA, 1449 bp, Chlamydia trachomatis
atggatactcccacacccctttcctccgtaccgacaaacgcttctcttaagggagaaccagggagctcctctcaattttcttctgcagaaaaaggggttctaaaaacaagcgtaggagacgttgttctgtctcaatctattgaagacggtggtaatgagactcagatctctctggtaggtgttgtgaatattaatatggctcaagaagaactccccactcttgttagccctcgaaccttcattttccttcctcccgagactgtcgagctggaaattcagattgcagaaatgttccaagctctagaagagaccccttcttctgatagtcgatccctccaacagaaggaaacctctgctcagacacctccagcaccttctgggaaagtttccatattttctttacaggcgcagggatcctcacagactcgctccttaccttcttctcaggagtccctatctccccaacaaccagctcgtgctatacagggactgaatactcccttctctccagcagcgcgctgcacaataagagccgttcctttgtctatcgtgcctcaccgtagagcaaatccaacatcttctcaaagtgtttctcatcatagctctcgtacttaccagacaggccattcaacaggaacggctcaactttcttcccaggaatgggaattttcttctcaaacagttaaaacctgctcaacaggaagagaaaaaagagacggtcaacaagaaagacattctgatcaagaacagaatagtgatcattcttaccaagaggaagatctctcggatgatatgcaagtgtcttcttctaaaagatcctctcatccggaagatgaaaatactgaggaagtattttctgtctctcactttgcttatcatgcggcccctcatccttcgtccaatttagatcaggagtcgaatcagagtactttccaaaaaagaccgccctcccctatgtccttgttttcttcccagaatgctacggaagaagctcctaaagaagctcgtgtcgaaaacgttttcttacgattcatgcgactcatggctagaattttaggccaagcagaagccgaggcacacgagttgtatctccgcgtcaaagaacgcacagataatgtcgatgcgctgacgttactcctgtcaaaaattaacaatgaaaaaggagccattgactggaatcaagatgaggaaatgcgcgctctcgtagatcaagctaaaaaactaggcgtcccaattggagactcctacgactggtctgaggaaggaaaaaagcttctgaaagaaaatatccaaatgcgcaaagaaaatatggagaaaatcactcagctagaacgcactgatatgcaacgccatctccaagaagtgtctcaatgccaccaagcaagatccaatgtcttgaaacttttaaaagaacttatggacacctttatctacaacatgcgtccctaa

SEQ ID NO: 237 - protein, 261 aa, Chlamydia trachomatis
MRLCFILFLLLSPLISEASQHIITVKTIHEIASDILYDDANYWLIFDIDDVLFEGAEALSHSAWFERSIQGMRALGTSEQEAWDTLYPDWLSIQRQGSIKQIETAIPLLITKVQNQNKIVFAYSERKVCAQDVTLEQLAKINLSFEKANLPYTSLPSNICFTKGVLFGSEIHKGPGLQRFLDAQPSLPEKVIYIDNEKYNVLRIGEVCKQKNIPYLGIVYTASKYHPPIYLPDIARIQYLYRQKLISNEAAALLSRHRLDK

SEQ ID NO: 238 - DNA, 786 bp, Chlamydia trachomatis
atgcgtctttgttttattctttttctattgctatctcctttaatctccgaagcttcgcagcacattattactgtgaaaactattcatgagattgcttcggacatcttgtatgatgatgcaaattactggctgatctttgatatcgatgacgttttgtttgagggagctgaagctctcagccattcagcttggtttgaacgctccatacaaggaatgcgggcattaggaacatccgagcaagaagcttgggacactctatatcctgattggctatctattcaacgtcaaggctctattaaacagatagaaactgctattcctctattaattaccaaagttcagaatcaaaacaaaatcgtctttgcctattcagagcgcaaagtatgcgcgcaagatgtgacattagaacaacttgctaagattaacctctcttttgagaaagcgaatcttccctataccagtctcccatcaaacatctgtttcacaaaaggcgttctttttggatctgaaattcataaaggacctggattacaacgtttcctagacgcccaaccctctttaccagagaaagtcatctacattgacaatgagaaatacaatgtcttacgtattggagaagtctgtaaacaaaaaaacatcccttatctagggattgtctatactgcctctaaatatcatcccccaatttatcttccagatattgccagaatacaatacctataccgccaaaagctcattagcaacgaagccgcagcactcttatctcgtcacaggctagataagtaa

SEQ ID NO: 239 - protein, 261 aa, Chlamydia trachomatis; identical to SEQ ID NO: 237

SEQ ID NO: 240 - DNA, 786 bp, Chlamydia trachomatis; identical to SEQ ID NO: 238

SEQ ID NO: 241 - protein, 261 aa, Chlamydia trachomatis; identical to SEQ ID NO: 237

SEQ ID NO: 242 - DNA, 786 bp, Chlamydia trachomatis; identical to SEQ ID NO: 238

SEQ ID NO: 243 - protein, 486 aa, Chlamydia trachomatis
MCFIGIGSLLLPTALRATERMRKEPIPLLDKQQSFWNVDPYCLESICACFVAHRDPLSAKQLMYLFPQLSEEDVSVFARCILSSKRPEYLFSKSEEELFAKLILPRVSLGVHRDDDLARVLVLAEPSAEEQKARYYSLYLDVLALRAYVERERLASAAHGDPERIDLATIEAINTILFQEEGWRYPSKQEMFENRFSELAAVTDSKFGVCLGTVVLYQAVAQRLDLSLDPVTPPGHIYLRYKDKVNIETTSGGRHLPTERYCECIKESQLKVRSQMELIGLTFMNRGAFFLQKGEFLQASLAYEQAQSYLSDEQISDLLGITYVLLGKKAAGEALLKKSAEKTRRGSSIYDYFQGYISPEILGVLFADSGVTYQETLEYRKKLVMLSKKYPKSGSLRLRLATTALELGLVKEGVQLLEESVKDAPEDLSLRLQFCKILCNRHDYVRAKYHFDQAQALLLKEGLFSEKTSYTLLKTIGKKLSLFAPS

SEQ ID NO: 244 - DNA, 1461 bp, Chlamydia trachomatis
atgtgctttattgggataggcagtcttctgttaccgaccgctctgcgagcgactgaacggatgagaaaggagcctatcccgctcctagataagcaacaaagcttttggaatgtagatccttattgtctggaatctatatgcgcttgttttgtagcgcatcgagatcctttgagtgcaaaacagttaatgtatctgtttcctcagctctcagaagaggatgtatctgtttttgctcgatgcattttgtcttcaaagcgtccagaatacctcttttcaaaatcggaggaagagctctttgcaaaattgattttgccaagggtttctctaggtgttcatcgggacgatgatttagcgagagtgttggtgttagcggagccttctgcagaagagcagaaggctcgatactattcattgtatctggatgttttagctttgcgtgcatacgttgaaagagagcgtttggcgagtgctgcacacggagatcctgagcggatagatttggcaaccatagaagctattaataccatcctttttcaggaagaaggatggaggtatccttcaaaacaagagatgtttgaaaacaggttttctgagttagctgctgttacagatagtaagtttggagtttgcttgggaactgtagtgctttatcaagctgtcgcccagcggcttgatttgtctctggaccctgtcacccctcctggacatatttacttacgctataaggacaaggtgaatattgaaaccacttctggaggaaggcatcttcctactgaaaggtattgtgaatgcataaaagagtcgcagttaaaggtgcgttcgcagatggagcttatagggttaacttttatgaatagaggagctttctttttgcaaaaaggagagtttcttcaggcgtccttagcttatgagcaagctcaatcatatttatcagacgagcagatttctgatttgttagggattacttatgttcttttaggaaagaaggcggcgggagaggctcttttaaagaaatctgcagaaaagactcggcgagggtcatctatctatgactatttccaaggatatatttcccccgaaatcctaggggtgttgtttgccgattcaggggtgacctatcaagaaactttggagtatcgaaaaaaactagtgatgctttccaagaagtatccaaaaagtggatctcttaggttgaggttggcgacaacagcattggagctagggctggtcaaggagggggtgcagttgttagaagagagtgttaaggatgccccagaggacctctctttacgtctgcagttttgtaaaattctttgcaatcgacatgattatgtccgagcaaaatatcattttgatcaagcgcaagctcttctcattaaagaagggttgttttccgaaaaaacttcctatactctcttaaaaactatcgggaaaaagctatctctttttgctccgagttaa

SEQ ID NO: 245 - protein, 236 aa, Chlamydia trachomatis
MLSKFCKLSLSAILLINTLAPSETFSEEGTSGFLGRMKSWILKDKTILSTTEESQTSAIEKVSDLLSWKRYDYTQESGFAIQFPESPEHSEQVIEVPQSDLAIRYDTYVAETPSDSTVYVVSIWEYPEKIDISRPELNLQEGFAGMLYALPESQVLYLKATALQGHKALEFWIACDDVYFRGMLVSVNHTLYQVFMVYKGRSPEILDKEYSTFIQSFKVTKVRNSKKMDIRKRVSL

SEQ ID NO: 246 - DNA, 711 bp, Chlamydia trachomatis
atgctttcaaagttctgcaaactttctttatctgctatccttttaattaatactttggctccttcagaaactttttctgaagaaggaacctcagggtttttagggaggatgaagtcctggatcttaaaggacaagactattctctctaccacagaggaatctcaaacctctgctatcgaaaaggtttcggatctcttgtcttggaagcgttatgattacacacaggaaagcggttttgctatccaatttcctgagtctcccgaacattcggagcaagtgatagaagtccctcaatcagatttggctattcgttacgatacctatgtagcagaaactcctagtgatagcacagtttatgtagtgtctatttgggaatatccagagaaaattgatatcagtagaccggaattgaaccttcaagaaggttttgcaggaatgttatacgcacttcctgaatcgcaagttctatatcttaaagcaacagctctacaaggacacaaagctttggaattttggatcgcatgcgacgatgtgtattttcgaggaatgcttgtctctgttaatcacacgctgtaccaagttttcatggtgtataagggacgttccccagaaattttagataaggaatacagcaccttcattcaatctttcaaagtcactaaggtacgaaactccaaaaaaatggacataagaaagcgtgtatctttatag

SEQ ID NO: 247 - protein, 316 aa, Chlamydia trachomatis
MASKSRHYLNQPWYIILFIFVLSLIAGTLLSSVYYVLAPIQQQAAEFDRNQQMLMAAQVISSDNTFQVYEKGDWHPALYNTKKQLLEISSTPPKVTVTTLSSYFQNFVRVLLTDTQGNLSSFEDHNLNLEEFLSQPTPVIHGLALYVVYAILHNDAASSKLSASQVAKNPTAIESIVLPIEGFGLWGPIYGFLALEKDGNTVLGTSWYQHGETPGLGANIANPQWQKNFRGKKVFLVSASGETDFAKTTLGLEVIKGSVSAALGDSPKAASSIDGISGATLTCNGVTESFSHSLAPYRALLTFFANSKPSGESHDH

SEQ ID NO: 248 - DNA, 951 bp, Chlamydia trachomatis
atggcatccaagtctcgccattatcttaatcagccttggtacattatcttattcatctttgttcttagtttaattgctggtaccctcctgtcttctgtgtattatgtccttgcacctatccaacagcaagctgcggaattcgatcgcaatcaacaaatgctaatggctgcacaagtaatttcttccgataacacattccaagtctatgaaaagggagattggcacccagccctatataatactaaaaagcagttgctagagatctcctctactcctcctaaagtaaccgtgacaactttaagctcatattttcaaaactttgttagagtcttgcttacagatacacaaggaaatctttcttcattcgaagaccataatctcaatctagaagaatttttatctcaaccaactcctgtaatacatggtcttgccctttatgtggtctacgctatcctacacaacgatgcagcttcctctaaattatctgcttcccaagtagcgaaaaatccaacagctatagaatctatagttcttcctatagaaggttttggtttgtggggacctatctatggattccttgctctagaaaaagacgggaatactgttcttggtacttcttggtatcaacatggcgagactcctggattaggagcaaatatcgctaaccctcaatggcaaaaaaatttcagaggcaaaaaagtatttctagtctcagcttctggagaaacagattttgctaagacaaccctaggactggaagttataaaaggatctgtatctgcagcattaggagactcacctaaagctgcttcttccatcgacggaatttcaggagctactttgacttgtaatggtgttaccgaatccttctctcattctctagctccctaccgcgctttgttgactttcttcgccaactctaaacctagtggagagtctcatgaccactaa

SEQ ID NO: 249 - protein, 408 aa, Chlamydia trachomatis
MMKPLRFGYFFCAIYFTLLQAAFAKEPNSCPDCQNNWKEVTHTDQLPENLLHADDACYHSGYVQALIDMHFLDSCCQVLVENQTAYLFSLPTDDVTRNAIINLIKDLPFIHSVEICQASYQTCHHQGPHGKTSLPEQRSFCTKVCGKEAIWLPQNTILFSPLVADPRQATNSAGIRFNDEVLGKRVGSATFGGDFIFLRLFDISRFHGDMDIGLQGAVFSVFDLDHPEACMVNSDFFVAALCNFAVNKWSYRFRLWHLSSHLGDEFLLANQLPPKKRYNRSDEAVDFFASFRYTPQIRVYGGIGYIISRDLTFPEDPLYFEGGIELRPFGLREDNLHAQPVFAMHFRFWEEHDFSIDQTYIVGMEWSKFQDVGRKVRAVLEYHQGFSHEGQFVREECDYYGFRLSYGF

SEQ ID NO: 250 - DNA, 1227 bp, Chlamydia trachomatis
atgatgaaacctctacgtttcggttatttcttttgcgcaatctattttactttgttacaggcagcgtttgctaaagaaccgaattcttgtcccgactgccagaataattggaaagaagtcacccacacggatcaactcccagaaaacatcattcatgctgatgatgcttgttatcactctggttatgtacaggctctcattgatatgcatttcttagatagctgctgccaggtcatcgttgaaaaccaaactgcttacttattttctcttcctacagatgatgttacgcgcaacgccattatcaacctaattaaagaccttccattcattcactccgtagaaatctgccaagcatcctatcaaacctgtcatcatcaaggccctcatggaaagacttctcttccagaacaacgttctttctgtacaaaggtctgtggaaaagaagctatttggttaccacagaataccatcctattctcgcctcttgtagcagatcctagacaagcaactaatagtgcaggtatccgttttaacgacgaagtcttaggaaaacgtgttggctctgctaccttcggtggagatttcatcttcttacgattatttgatatctcccgattccatggagacatggatattggtctccaaggagctgtattctctgttttcgacctggatcatccagaagcttgcatggtcaactctgacttttttgtcgccgctttgtgcaactttgcagtgaacaaatggagctaccgcttcagactatggcatctttcttctcatcttggcgacgaatttattcttgccaaccagttacctcctaaaaaacgttataatcgaagcgatgaagccgtcgatttctttgcttcttttcgttacactccacagatccgtgtttatggaggtattgggtatatcattagtcgagatttaacattccctgaagatcctctttactttgaaggaggtatcgaactacgtcctttcggattacgggaagacaaccttcatgcccaacccgtctttgctatgcattttcgcttttgggaagagcatgacttttctatagaccaaacttatatagtaggcatggagtggtccaaattccaggatgtagggagaaaagtgcgcgctgtattggaataccaccaaggtttctcccacgaaggacaatttgtccgagaagaatgcgattattatggctttcgattaagttatggcttctag

SEQ ID NO: 251 - protein, 335 aa, Chlamydia trachomatis
MLLRKFCGYLFCSSLVCSFISVIVVSFRSEPITPSVAIFSSFSHNSLSECIESCQKELTSFGNMPTISLFNSEDNVVKARKIARTLHKDPNVVMIITLGPIATKVMSQIETQKPIIYAVVPAGEALRFPKEQVNIYGVNDSVDTNQCCFAIHAVTNNANSLVYLQPHEPFPSSLQEEITNKLRASGIKVTELPISAANMSSRIQFLAENRPSAVFFPLSSLSEKMGTTLIKSILKENIPLITDDSSLVMEGACAACSVDYKLSGKQIACIVRYLLSKKNNEEHLNQISAEPILSKITFNEEIIRFLGLPFNVAPAHQFISFHSADNTGLVTLQIP

SEQ ID NO: 252 - DNA, 1008 bp, Chlamydia trachomatis
atgcttttgcgaaaattttgtggctatcttttttgtagttccctagtttgttcttttatttccgtcattgttgtttcctttcgttcagaaccaataacgcctagcgttgctatcttctcttccttttcccataattctcttagtgaatgcatagagagttgtcaaaaagaactgaccagctttgggaacatgcccactatctccctatttaattctgaggataatgtagtcaaagcaagaaaaatcgctcgcacccttcataaagaccctaatgttgtcatgatcattactttaggccccattgcaactaaagtaatgagtcaaatcgaaacacaaaaaccgatcatttatgctgttgtccctgcaggagaagctctccgattcccaaaagagcaggttaatatatacggggttaatgatagcgtagacacaaaccaatgttgtttcgcgattcatgcggtaaccaacaacgcgaattcgttggtttatctacaaccccacgaacctttcccttcttccttacaggaagaaattacaaataaactccgcgcgtcaggcattaaagtgacagaacttcctatttctgcagccaacatgtcgtctcgcattcagtttattgcagaaaatcgtccttccgcagtctttttccctctttcttccctatcagaaaaaatgggaacgacgctcattaaaagcatcttaaaagaaaatattcctctgatcacagatgactcttcccttgttatggaaggtgcttgtgcagcatgtagcgttgattataaactatcaggcaaacaaatagcctgtatcgttcgttatttgctcagcaagaaaaacaatgaagagcatttgaaccagattagcgcagagccgatcctttccaaaattactttcaatgaggaaattatccggttcttaggacttccatttaatgtggctccggctcaccaatttatctctttccactctgcagataatactggattagtgactttacaaatcccttaa

SEQ ID NO: 253 - protein, 563 aa, Chlamydia trachomatis
MTTLLSFLTSLCSAAIHQAFPELEELTLDITPSTKEHFGHYQCNDAMKLARVLHKSPRALAESIVAHIPPTPFSSIEIAGAGFINFTFSKEFLASQLQTFSKELANGFRAASPQKVIIDFSSPNIAKDMHVGHLRSTIIGDCLARCFSFVGHDVLRLNHIGDWGTAFGMLITYLQETSQEAIHQLEDLTALYKKAHARFAEDSEFKKRSQHNVVALQSGDAQALALWKQICSVSEKSFQTIYSILDVELHTRGESFYNPFLAEVVADLESKNLVTLSDGAKCVFHEAFSIPLMIQKSDGGYNYATTDVAAMRYRIQQDQADRILIVTDSGQSLHFQLLEATCLAAGYLPSKGIFSHVGFGLVLDTQGRKFKTRSGENIKLRELLDTAVEKAKESLKAHRPDISEEELAYQGPILGINAIKYADLSSHRINDYVFSFEKMLRFEGNTAMSLLYAYVRIQGIKRRMGLESPPQEGPLAVHEPAEEALALTLLRFPEILDLTLRELCPHFLTDYLYALTNKFNAFFRDCHIEGSDSQQERLYLCGLTERTLSTGMHLLGLKTLNHL

SEQ ID NO: 254 - DNA, 1692 bp, Chlamydia trachomatis
atgacaacacttctttcttttctgacttcgctatgttctgcagcgattcatcaagccttccctgagttggaagagctaaccttagacatcactccctctactaaggagcattttggacattatcaatgtaacgatgcaatgaaacttgcacgtgtattacacaaatcccctcgtgccattgccgaatcgatcgttgcgcatattcctcccactcctttttcctctatagagattgcaggagctggatttatcaattttactttctcaaaagaattcctagctagtcagctccaaaccttctcaaaagaattagcaaatgggtttcgtgctgcgtctcctcaaaaagttattattgatttttcttctcctaatattgctaaagatatgcatgtaggccatctgcgctccacgattatcggagattgtttagcacgatgcttttcctttgtcggccatgacgtcttacgcttaaaccatattggagattggggtacagcttttggtatgctaatcacctatctgcaagagacctctcaggaggcgattcatcaactagaagatctcactgcattatataaaaaggctcacgcgcgtttcgcagaagactctgaatttaaaaaacgctcccaacataacgttgtagccttacaatccggagatgctcaagctcttgcactatggaaacaaatctgttccgtttctgagaaatcctttcagacaatctactcgattttggatgttgagctccatacacgcggcgaatcattttataatcctttcctagcagaggttgtcgcagacttagaatctaaaaaccttgtcacgctttctgatggcgcaaaatgcgtattccatgaagccttctctattcctctcatgattcaaaagagtgatggcggatacaattacgcaacaaccgatgtcgcagctatgcgctatcgcatccaacaagatcaggccgatagaattcttatcgttacagactcaggacaatccttacacttccagcttctagaagcaacgtgcttagcagcaggctatcttccttctaaagggatcttttcacatgtaggatttggacttgtcttggatactcaaggaagaaaattcaaaacacgttcgggagagaacatcaaattacgagaacttctcgatacagcagtggaaaaagcgaaagagtctctaaaagcacatcgtccagacatctcagaagaagaactggcatatcaaggccctatccttggtattaatgcaattaaatatgcagacctttcttctcatagaatcaatgactacgtgttctctttcgagaagatgctccgcttcgaaggaaatacagcgatgtctctcctgtatgcctatgtacgtatccaaggaattaaacgcagaatgggattagaatctccgcctcaagaagggcctcttgctgttcatgagcctgcagaagaagcgttagcacttactcttttacgtttccctgaaattttggacctcaccctcagagaactctgtcctcatttcctaactgactatctctatgcactcaccaataagttcaatgctttcttccgcgattgccatatcgaaggatccgattctcagcaagaacgtctttatctctgcggacttaccgaacgaacgctatcaacaggtatgcacttactaggtcttaaaaccttgaatcacctgtaa

SEQ ID NO: 255 - protein, 1005 aa, Chlamydia trachomatis
MTNSISGYQPTVTTSTSSTTSASGASGSLGASSVSTTANATVTQTANATNSAATSSIQTTGETVVNYTNSASAPNVTVSTSSSSTQATATSNKTSQAVAGKITSPDTSESSETSSTSSSDHIPSDYDDVGSNSGDISNNYDDVGSNNGDISSNYDDAAADYEPIRTTENIYESIGGSRTSGPENTSGGAAAALNSLRGSSYSNYDDAAADYEPIRTTENIYESIGGSRTSGPENTSGGAAAALNSLRGSSYSNYDDAAADYEPIRTTENIYESIGGSRTSGPENTSDGAAAAALNSLRGSSYTTGPRNEGVFGPGPEGLPDMSLPSYDPTNKTSLLTFLSNPHVKSKMLENSGHFVFIDTDRSSFILVPNGNWDQVCSIKVQNGKTKEDLDIKDLENMCAKFCTGFSKFSGDWDSLVEPMVSAKAGVASGGNLPNTVIINNKFKTCVAYGPWNSQEASSGYTPSAWRRGHRVDFGGIFEKANDFNKINWGTQAGPSSEDDGISFSNETPGAGPAAAPSPTPSSIPIINVNVNVGGTNVNIGDTNVNTTNTTPTTQSTDASTDTSDIDDINTNNQTDDINTTDKDSDGAGGVNGDISETESSSGDDSGSVSSSESDKNASVGNDGPAMKDILSAVRKHLDVVYPGENGGSTEGPLPANQTLGDVISDVENKGSAQDTKLSGNTGAGDDDPTTTAAVGNGAEEITLSDTDSGIGDDVSDTASSSGDESGGVSSPSSESNKNTAVGNDGPSGLDLLAAVRKHLDKVYPGDNGGSTEGPLQANQTLGDIVQDMETTGTSQETVVSPWKGSTSSTESAGGSGSVQTLLPSPPPTPSTTTLRTGTGATTTSLMMGGPLKADIITTGGGGRIPGGGTLEKLLPRLRAHLDISFDAQGDLVSTEEPQLGSIVNKFRQETGSRGLLAFVESAPGKPGSAQVLTGTGGDKGNLFQAAAAVTQALGNVAGKVNLAIQGQKLSSLVNDDGKGSVGRDLFQAAAQTTQVLSALIDTVG

SEQ ID NO: 256 - DNA, 3018 bp, Chlamydia trachomatis
atgacgaattctatatcaggttatcaacctactgttacaacttctacatcatcaaccacttcggcatcaggtgcttccggatctctgggagcttcttctgtatctactaccgcaaacgctacagttacacaaacagcaaacgcaacaaattcagcggctacatcttctatccaaacgactggagagactgtagtaaactatacgaattcagcctccgcccccaatgtaactgtatcgacctcctcttcttccacacaagccacagccacttcgaataaaacttcccaagccgttgctggaaaaatcacttctccagatacttcagaaagctcagaaactagctctacctcatcaagcgatcatatccctagcgattacgatgacgttggtagcaatagtggagatattagcaacaactacgatgacgtaggtagtaacaacggagatatcagtagcaattatgacgatgctgctgctgattacgagccgataagaactactgaaaatatttatgagagtattggtggctctagaacaagtggcccagaaaatacaagtggtggtgcagcagcagcactcaattctctaagaggctcctcctacagcaattatgacgatgctgctgctgattacgagccgataagaactactgaaaatatttatgagagtattggtggctctagaacaagtggcccagaaaatacgagtggtggtgcagcagcagcactcaattctctaagaggctcctcctacagcaattatgacgatgctgctgctgattacgagccgataagaactactgaaaatatttatgagagtattggtggctctagaacaagtggcccagaaaatacgagtgatggtgcagcagcagcagcactcaattctctaagaggctcctcctacacaacagggcctcgtaacgagggtgtattcggccctggaccggaaggactaccagacatgtctcttccttcatacgatcctacaaataaaacctcgttattgactttcctctccaaccctcatgtaaagtcgaaaatgcttgaaaactcggggcatttcgtcttcattgatacagatagaagtagtttcattcttgttcctaacggaaattgggaccaagtctgttcaattaaagttcaaaatggaaagaccaaagaagatctcgacatcaaagacttggaaaacatgtgtgcaaaattctgtacagggtttagcaaattctctggtgactgggacagtcttgtagaacctatggtgtcagccaaagctggagtggccagcggaggcaatcttcccaatacagtgattatcaataataaattcaaaacttgcgttgcttatggtccttggaatagccaggaagcaagttctggttatacaccttctgcttggagacgtggtcatcgagtagattttggaggaatttttgagaaagccaacgactttaataaaatcaactggggaactcaagccgggcctagtagcgaagacgatggcatttccttctccaatgaaactcctggagctggtcctgcagctgctccatcaccaacgccatcctctattcctatcatcaatgtcaatgtcaatgttggcggaactaatgtgaatattggagatacgaatgtcaacacgactaacaccacaccaacaactcaatctacagacgcctctacagatacaagcgatatcgatgacataaataccaacaaccaaactgatgatatcaatacgacagacaaagactctgacggagctggtggagtcaatggcgatatatccgaaacagaatcctcttctggagatgattcaggaagtgtctcttcctcagaatcagacaagaatgcctctgtcggaaatgacggacctgctatgaaagatatcctttctgccgtgcgtaaacacctagacgtcgtttaccctggcgaaaatggcggttctacagaagggcctctcccagctaaccaaactctcggagacgtaatctctgatgtagagaataaaggctccgctcaggatacaaaattgtcaggaaatacaggagctggggatgacgatccaacaaccacagctgctgtaggtaatggagcggaagagatcactctttccgacacagattctggtatcggagatgatgtatccgatacagcgtcttcatctggggatgaatccggaggagtctcctctccctcttcagaatccaataaaaatactgccgttggaaatgacggaccttctggactagatatcctcgctgccgtacgtaaacatttagataaggtttaccctggcgacaatggtggttctacagaagggcctctccaagctaaccaaactcttggagatatcgtccaggatatggaaacaacagggacatcccaagaaaccgttgtatccccatggaaaggaagcacttcttcaacggaatcagcaggaggaagtggtagcgtacaaacactactgccttcaccacctccaaccccgtcaactacaacattaagaacgggcacaggagctaccaccacatccttgatgatgggaggaccaatcaaagctgacataataacaactggtggcggaggacgaattcctggaggaggaacgttagaaaagctgctccctcgtatacgtgcgcacttagacatatcctttgatgcgcaaggcgatctcgtaagtactgaagagcctcagcttggctcgattgtaaacaaattccgccaagaaactggttcaagaggaatcttagctttcgttgagagtgctccaggcaagccgggatctgcacaggtcttaacgggtacagggggagataaaggcaacctattccaagcagctgccgcagtcacccaagccttaggaaatgttgcagggaaagtcaaccttgcgatacaaggccaaaaactatcatccctagtcaatgacgacgggaaggggtctgttggaagagatttattccaagcagcagcccaaacaactcaagtgctaagcgcactgattgataccgtaggataa

SEQ ID NO: 257 - protein, 343 aa, Chlamydia trachomatis
MRTFFLLYRFFICLAPFFLSFPLYADPHTVLTKGLAAAVVHADSGAILKEKNLDHKIFPASMTKIATALLILRQYPDVLTRFITTRREPLTSITPQAKQQSGYRSPPHWLETDGMTIQLKVKEEVSGWDLFHALLISSANDAANVLADACCQSVSAFMRQLNEFLRELGCQNTHFNSPHGLHHPDHYTTARDLSLIMKEALKEPLFRQVIHTASYTMEATNLSPERVLSSTNKLLSSSSTYFYPPCLGGKTGTTKSAGKNIIFAAEKNNRSIIVVAAGYFGPAAQLYQDAIALCEDLFNEQLLRCFLIPPASHYPVPTRFGTVTAPVAQGIYYDFYPSEEIPS

SEQ ID NO: 258 - DNA, 1032 bp, Chlamydia trachomatis
atgcgtacttttttcttgttgtatcggttctttatctgcttggctcccttttttctctcgtttcctttgtacgcagatccccatactgttcttacaaaaggaatcgcagccgcagtcgttcatgcagattccggagcgattctgaaagaaaaaaatctggaccacaagattttccctgcaagcatgaccaagattgcaaccgctttactcattttaaggcagtatcctgatgtgttaactcgtttcatcactactcgcagagagccactgacttctatcactcctcaggctaaacaacaatccggataccgaagccctccccattggctagaaactgatggtatgactattcaactaaaagtgaaggaagaggtgtctggatgggacctttttcacgctctacttattagctctgcaaatgatgctgccaatgttttagcagatgcctgctgccaaagcgtctctgctttcatgcgccaacttaatgagtttttgagggaactcggttgccaaaatactcattttaattctcctcatggactccatcatcctgatcactacacgacagctagagatctatcactcatcatgaaagaagctttaaaagagcctcttttccgccaagtcattcacacagcgtcctataccatggaggccaccaacttaagtccagaaagagttctgtcttccacgaacaaacttctttcttcctcttcgacttacttttatccaccttgtttaggagggaaaacaggaactacaaaaagtgcagggaaaaatatcattttcgctgcagaaaagaacaatcgctcaattattgttgtagcagcaggatattttggccctgctgctcaactataccaagatgctatagctctgtgcgaagatctatttaatgaacagctattacgatgctttttaatccctcccgcaagtcactatcctgtaccaactcgatttggcactgtgacagctccggtagcacaaggcatttattacgacttttatccttccgaagagatcccctcttaa

SEQ ID NO: 259 - protein, 278 aa, Chlamydia trachomatis
MTANTFGILNILMKQAKADDLAQFLPEHLLLDSPHHQDIPLQSLSFNMRWLATIHPSWISVAMKEFPPVVQSQLLAWLPLPLTQELLPLLDSGVTPATKRCLDFGAFYLLDLLSKKVRPPGITEEIFLPASPFNAMLYYVGPTKMALINCLGLYTLAQEMRNVVDRVVIDRVQRVLSETERMFLNYCKTHPMKHLEPMAFLASWEEDQALRHFIHVQGLRFLARALAKEDSSFLWYFIRRLDVGRGYIFEKALQSSIDSPHNEYFRERLEHCISILVQ

SEQ ID NO: 260 - DNA, 837 bp, Chlamydia trachomatis
gtgacagcgaatacctttgggattcttaatatcctgatgaagcaggcaaaagctgatgatttagctcagtttctgccggaacatcttctactagattctccgcatcatcaggatattcctctgcagtccttatctttcaatatgcgttggttagcaaccattcatccttcctggattagtgttgctatgaaagaattccctcccgttgtgcaatcgcaattattagcttggttacctctccctctaacgcaagaactactccctcttttagattctggagttacccctgctacaaaacgctgcttagactttggagctttctacctacttgacttactcagtaagaaagtacgtcctccaggcattacagaagagatttttctccccgcttctcctttcaatgctatgctgtactatgtaggccctaccaaaatggccttgatcaattgtctagggctttataccttagctcaagaaatgcgaaacgtagtcgatcgtgtagtcattgatcgcgtgcagcgtgtgttatccgaaacggaacggatgtttctaaattattgtaaaacacatcctatgaaacatctggaacctatggcctttttagcctcttgggaggaagatcaagctttacgtcatttcatccatgttcaaggtttgcgcttcttagctcgcgctctagcaaaagaagatagctctttcctttggtattttattcgcagacttgatgtcggaagaggctatattttcgaaaaagcattgcagagttcgatagatagtccccataatgagtattttcgagagcgcttagaacactgtatcagtattcttgtgcaataa

SEQ ID NO: 261 - protein, 441 aa, Chlamydia trachomatis
MWLIVASTLLACLAMALVFKAYRHVISFRSYVNQVIRDVRLSVDLKEWAVAEMRLAPILKKRQYRRKYLFEYIRILRELERFEEAEKLLGEAKKLKLAGAHFFLEVAHKAFRHGAYKEAAHAFSLLSAELMGEREVARYTISLVYLGEVDAACRIIEPWIGPLAHQEVFISVGHIYFATKRYADAIDFYRRARSLGSCPIDVLYNLAHSLRICGQYVDAGMLFRELLGDPVYKDEAMFNIGLCEQKLGNSKKALLIYQNSELWVRGDALMMRYAALAAADQQDYQLAEHCWTLAFRCQSYADDWNCCVHYGLALCHLKKYAEAEKVYLRVIQKTPDCLVACKALAWLAGVGHATMISAREGIAYAKRALQIKRSPEVLELLSACEAREGNFDVAYDIQAILAERDTTAKERERRSQILKNLRQKLPIDQQHLVEVSLLLAA

SEQ ID NO: 262 - DNA, 1326 bp, Chlamydia trachomatis
atgtggctaatcgtagcatcgacactcttggcttgcttagcgatggctttagtctttaaagcttataggcatgttatcagcttccgcagctacgtgaatcaagtgatacgggatgtgcgcttgagcgtagatttaaaagagtgggcggtcgcagaaatgcgcttggccccgatcctgaaaaaacgtcaatatcgacgtaaatatttattcgaatatatccgtattcttcgagagctcgaacgttttgaagaagctgaaaagcttttgggagaagctaagaaattgaaattagcaggtgcccattttttcttagaggttgcacataaggctttccggcatggcgcctataaagaggctgcacatgctttttctcttctttccgctgagcttatgggcgagcgagaggtcgctcgctacaccatttctctggtatatcttggagaagtagatgctgcttgtcggatcattgaaccatggattggtccacttgctcaccaagaagtctttattagcgtaggacatatctattttgcgacgaagcgctatgcagatgctatcgatttctatcgacgcgcacggtccctaggatcttgccctatcgatgttttgtacaacttagcacattctttgcgtatttgcgggcagtatgtcgatgctgggatgctctttagagagcttttaggggatccggtttataaagacgaagcgatgtttaatatcggcttatgtgagcaaaaattagggaattcgaaaaaggctctgctgatctatcaaaatagtgagttatgggttcgcggagatgctttgatgatgcggtatgcagctcttgcggcggcggatcagcaagattatcagctcgcagagcactgctggacattagctttccgttgtcaaagttatgctgatgattggaattgctgtgttcattatggtttagcattatgccatttaaagaaatatgccgaggctgagaaggtatatttaagagtgattcaaaagactccggattgtttggttgcttgtaaagcactggcttggctcgcaggagtcggacatgcgacgatgatttctgctcgagaaggaatagcttatgctaagcgagcgctgcagatcaaacgatctccggaagtactcgagttattgagtgcttgtgaagctcgagaaggtaattttgatgttgcttatgatattcaggctattttagccgagcgagatacgacggcgaaggaacgtgagcgacggtcacagattttgaagaatttacgacagaaacttcctatagaccaacagcatatagtagaggtttctttactgctagctgcctag

We claim:

1. A method of eliciting an immune response to a protein comprising the amino acid sequence of SEQ ID NO:255, comprising administering to a patient an effective amount of a protein comprising the amino acid sequence of SEQ ID NO:255, whereby an immune response to the administered protein is elicited.

2. A method of raising an antibody to a protein comprising the amino acid sequence of SEQ ID NO:255, comprising administering to a patient a protein comprising the amino acid sequence of SEQ ID NO:255, whereby an antibody that binds to the administered protein is raised.

* * * * *